(12) United States Patent
Gradinaru et al.

(10) Patent No.: US 11,858,969 B2
(45) Date of Patent: Jan. 2, 2024

(54) ENGINEERED LIGHT-SENSITIVE PROTEINS

(71) Applicant: California Institute of Technology, Pasadena, CA (US)

(72) Inventors: Viviana Gradinaru, La Canada Flintridge, CA (US); Claire N. Bedbrook, Pasadena, CA (US); Frances H. Arnold, La Canada Flintridge, CA (US); Kevin K. Yang, Cambridge, MA (US)

(73) Assignee: California Institute of Technology, Pasadena, CA (US)

( * ) Notice: Subject to any disclaimer, the term of this patent is extended or adjusted under 35 U.S.C. 154(b) by 986 days.

(21) Appl. No.: 16/573,321

(22) Filed: Sep. 17, 2019

(65) Prior Publication Data

US 2020/0087358 A1 Mar. 19, 2020

Related U.S. Application Data

(60) Provisional application No. 62/732,953, filed on Sep. 18, 2018.

(51) Int. Cl.
| | |
|---|---|
| *A61K 38/00* | (2006.01) |
| *A61K 38/16* | (2006.01) |
| *C07K 14/405* | (2006.01) |
| *A61P 27/02* | (2006.01) |
| *C12N 15/86* | (2006.01) |
| *A61N 5/06* | (2006.01) |

(52) U.S. Cl.
CPC ............ *C07K 14/405* (2013.01); *A61N 5/062* (2013.01); *A61N 5/0622* (2013.01); *A61P 27/02* (2018.01); *C12N 15/86* (2013.01); *A61K 38/00* (2013.01); *A61N 2005/063* (2013.01); *A61N 2005/0647* (2013.01); *C12N 2750/14132* (2013.01); *C12N 2750/14143* (2013.01)

(58) Field of Classification Search
CPC ...... A61K 38/00; A61K 38/16; C07K 14/405; A61N 5/062; A61N 5/0622; A61N 2005/063; A61N 2005/0647
See application file for complete search history.

(56) References Cited

U.S. PATENT DOCUMENTS

| | | | | |
|---|---|---|---|---|
| 10,052,383 | B2 * | 8/2018 | Deisseroth | C07K 14/405 |
| 10,350,246 | B2 * | 7/2019 | Light | A61K 35/35 |
| 10,392,426 | B2 * | 8/2019 | Klapoetke | A61K 41/00 |
| 10,435,709 | B2 * | 10/2019 | Deisseroth | C12N 9/1241 |
| 10,882,892 | B2 * | 1/2021 | Klapoetke | C07K 14/43581 |
| 2004/0022766 | A1 * | 2/2004 | Acland | C12N 15/86 |
| | | | | 424/93.2 |
| 2012/0232133 | A1 | 9/2012 | Balazs et al. | |
| 2014/0324134 | A1 * | 10/2014 | Klapoetke | A61K 41/0023 |
| | | | | 435/29 |
| 2015/0360049 | A1 * | 12/2015 | Kaplitt | A61N 5/0622 |
| | | | | 607/88 |
| 2016/0045599 | A1 | 2/2016 | Deisseroth et al. | |
| 2017/0095556 | A1 | 4/2017 | Deisseroth et al. | |
| 2017/0333486 | A1 | 11/2017 | Light | |

OTHER PUBLICATIONS

Klapoetke et al, Nature Methods 11(3): 338-446, (17 pages), available online Feb. 9, 2014.*
Klapoetke et al, GenBank AHH02144.1, Jan. 29, 2014.*
Parak et al, Electrically Excitable Normal Rat Kidney Fibroblasts: A New Model System for Cell-Semiconductor Hybrids, Biophys. J. 76: 1659-1667, 1999.*
Natasha et al, Channelrhodopsins: visual regeneration and neural activation by a light switch, New Biotechnol. 30(5): 461-474, 2013.*
Geeraerts et al, Shining a light on glaucoma: optogenetic brain stimulation confers retinal neuroprotection, Abstract, Neuroscience 2017, Nov. 11-15, 2017, Washington, DC.*
The Jackson lab, www.jax.org/jax-mice-and-services/strain-data-sheet-pages/body-weight-chart-000664; last accessed Oct. 31, 2022.*
Ye et al., Human Gene Therapy 27(1): 37-48, Mar. 8, 2016.*
Kingdoms of Life, waynesword.palomar.edu/trfeb98.htm, last visited Apr. 8, 2021.*
Mammal, en.wikipedia.org/wiki/Mammal, last visited Aug. 31, 2022.*
Mongabay, How many plant species are there in the world? Scientists now have an answer, https://news.mongabay.com/2016/05/many-plants-world-scientists-may-now-answer/; May 12, 2016; last visited Jan. 7, 2020.*
Fumoto et al, Targeted Gene Delivery: Importance of Administration Routes, INTECH, Novel Gene Therapy Approaches, p. 3-31; editors Wei and Good, publisher Books on Demand, 2013.*
Daya et al, Gene Therapy Using Adeno-Associated Virus Vectors, Clin. Microbiol. Rev. 21(4): 583-593, 2008.*
Mingozzi and High, Immune responses to AAV vectors: overcoming barriers to successful gene therapy, Blood 122(1): 23-36, 2013.*
Kattenhorn et al, Adeno-Associated Virus Gene Therapy for Liver Disease, Human Gene Therapy 27(12): 947-961, Nov. 28, 2016.*
Sasse et al, Circulation: Arrhythmia and Electrophysiology 4(5): 598-600, available Oct. 1, 2011.*
Nussinovitch et al, Nature Biotechnology 33(7): 750-754, Jul. 2015.*
Jiang et al, EP Eurospace 20(11): 1741-1749, 2018.*
Entcheva et al, Nature Reviews Cardiology 18: 349-367, 2021.*
Bedbrook et al, Genetically Encoded Spy Peptide Fusion System to Detect Plasma Membrane-Localized Proteins In Vivo, Chemistry & Biology 22: 1108-1121, 2015.*
Kato et al, Crystal structure of the channelrhodopsin light-gated cation channel, Nature 482: 369-375, 2012.*

(Continued)

*Primary Examiner* — Kevin K Hill
(74) *Attorney, Agent, or Firm* — Sheppard, Mullin, Richter & Hampton LLP

(57) ABSTRACT

Disclosed herein are engineered light-sensitive proteins, for example channelrhodopsins and variants thereof. Also disclosed are compositions for expressing the light-sensitive proteins in cells, tissues, organs and subjects, and methods for using the light-sensitive proteins to, for example, enable minimally-invasive neuronal circuit interrogation in living organism, and treat neuronal and ocular disorders.

11 Claims, 53 Drawing Sheets
(51 of 53 Drawing Sheet(s) Filed in Color)
Specification includes a Sequence Listing.

(56) References Cited

OTHER PUBLICATIONS

Bamann et al., "Structural Guidance of the Photocycle of Channelrhodopsin-2 by an Interhelical Hydrogen Bond," Biochemistry 2010, 49, 267-278.
Bedbrook et al., "Genetically Encoded Spy Peptide Fusion System to Detect Plasma Membrane-Localized Proteins in vivo," Chemistry & Biology 2015, 22(8), 1108-1121.
Bedbrook et al., "Machine learning-guided channelrhodopsin engineering enables minimally invasive optogenetics," Nature Methods 2019, 16, 1175-1184.
Berndt et al., "Structural foundations of optogenetics: Determinants of channelrhodopsin ion selectivity," PNAS 2015, 1-8.
Berndt et al., "Bi-stable neural state switches," Nature Neuroscience 2008, 1-6.
Challis et al., "Systemic AAV vectors for widespread and targeted gene delivery in rodents," Nature Protocols 2019, 14, 379-414.
Chuong et al., "Noninvasive optical inhibition with a red-shifted microbial rhodopsin," Nature Neuroscience 2014, 17(8), 1123-1129.
Deverman et al., "Cre-dependent selection yields AAV variants for widespread gene transfer to the adult brain," Nature Biotechnology 2016, 32(2), 204-209.
Fan et al., "Reduced Hyperpolarization-Activated Current Contributes to Enhanced Intrinsic Excitability in Cultured Hippocampal Neurons from PrP−/− Mice," Frontiers in Cellular Neuroscience 2016, 10(74), 1-10.
Flytzanis et al., "Archaerhodopsin variants with enhanced voltage-sensitive fluorescence in mammalian and Caenorhabditis elegans neurons," Nature Communications 2014, 5(4894), 1-9.
"GenBank Accession No. AHA49645.1, oChD protein [synthetic construct]," NCBI 2013, available at https://www.ncbi.nlm.nih.gov/protein/AHA49645.
"GenBank Accession No. AHA49646.1, oChEF protein [synthetic construct]," NCBI 2013, available at https://www.ncbi.nlm.nih.gov/protein/AHA49646.
Govorunova et al., "Natural light-gated anion channels: a family of microbial rhodopsins for advanced optogenetics," Science 2015, 349(6248), 647-650.
Gradinaru et al., "Molecular and Cellular Approaches for Diversifying and Extending Optogenetics," Cell 2010, 141, 154-165.
Gradinaru et al., "Targeting and Readout Strategies for Fast Optical Neural Control In Vitro and In Vivo," The Journal of Neuroscience 2007, 27(52), 14231-14238.
Gunaydin et al., "Ultrafast optogenetic control," Nature Neuroscience 2010, 13(3), 387-393.
Hochbaum et al., "All-optical electrophysiology in mammalian neurons using engineered microbial rhodopsins," Nature Methods 2014, 11(8), 825-833.
Hunter et al., "Matplotlib: A 2D Graphics Environment," Computing in Science and Engineering 2007, 90-95.
International Search Report and Written Opinion dated Jan. 3, 2020.
Kato et al., "Crystal structure of the channelrhodopsin light-gated cation channel," Nature 2012, 482, 369-374.
Klapoetke et al., "Independent Optical Excitation of Distinct Neural Populations," Nature Methods 2014, 11(3), 338-346.
Kroon et al., "Early postnatal development of pyramidal neurons across layers of the mouse medial prefrontal cortex," Scientific Reports 2019, 9(5037), 1-16.
Lin, "A user's guide to channelrhodopsin variants: features, limitations and future developments," Experimental Physiology 2010, 96(1), 19-25.
Lin et al., " ReaChR: A red-shifted variant of channelrhodopsin enables deep transcranial optogenetic excitation," Nature Neuroscience 2013, 16(10), 1499-1508.
Lin et al., "Characterization of Engineered Channelrhodopsin Variants with Improved Properties and Kinetics," Biophysical Journal 2009, 96, 1803-1814.
Mattis et al., "Principles for applying optogenetic tools derived from direct comparative analysis of microbial opsins," Nature Methods 2012, 9(2), 159-172.
Nagel et al., "Light Activation of Channelrhodopsin-2 in Excitable Cells of Caenorhabditis elegans Triggers Rapid Behavioral Responses," Current Biology 2005, 15, 2279-2284.
Oliphant, "Python for Scientific Computing," Computing in Science and Engineering 2007, 10-20.
Pascoli et al., "Sufficiency of Mesolimbic Dopamine Neuron Stimulation for the Progression to Addiction," Neuron 2015, 88, 1054-1066.
Pedregosa et al., "Scikit-learn: Machine Learning in Python," Journal of Machine Learning Research 2011, 12, 2825-2830.
Rajasethupathy et al., "Projections from neocortex mediate top-down control of memory retrieval," Nature 2015, 526, 653-659.
Robert et al., Deciphering key features in protein structures with the new ENDscript server, Nucleic Acids Research 2014, 42, W320-W324.
Romero et al., "Exploring protein fitness landscapes by directed evolution," Nature 2009, 10, 866-876.
Romero et al., "Navigating the protein fitness landscape with Gaussian processes," PNAS 2012, 1-9.
Slomowitz et al., "Interplay between population firing stability and single neuron dynamics in hippocampal networks," eLife 2015, 4(e04378), 1-21.
Smith et al., "Chimeragenesis of distantly-related proteins by noncontiguous recombination," Protein Science 2012, 22, 231-238.
Van Aerde et al., "Morphological and Physiological Characterization of Pyramidal Neuron Subtypes in Rat Medial Prefrontal Cortex," Cerebral Cortex 2015, 25, 788-805.
Voigt et al., "Protein building blocks preserved by recombination," Nature Structural Biology 2002, 9(7), 553-558.
Walt et al., "The NumPy Array: A Structure for Efficient Numerical Computation," Computing in Science and Engineering 2011, 22-30.
Wietek et al., "Conversion of Channelrhodopsin into a Light-Gated Chloride Channel," Science 2014, 344 (6182), 409-412.
Wright, "Gene Therapy for the Eye," British Journal of Opthamologist 81, 620-622.
Yang et al., "Machine-learning-guided directed evolution for protein engineering," Nat Methods 2019, 16, 687-694.
Yizhar et al., "Optogenetics in Neural Systems," Neuron 2011, 71, 9-34.
Zhang et al., "Optogenetic interrogation of neural circuits: technology for probing mammalian brain structures," Nature Protocols 2010, 5(3), 439-456.
Bedbrook et al., "Structure-guided SCHEMA recombination generates diverse chimeric channelrodopsins," PNAS Mar. 2017, E2624-E2633.
Bedbrook et al., "Machine learning to design integral membrane channelrhodopsins for efficient eukaryotic expression and plasma membrane localization," PLOS Computational Biology Oct. 2017, 13(10), 1-21.
Bedbrook et al., "Viral Strategies for Targeting the Central and Peripheral Nervous Systems," Annual Review of Neuroscience Apr. 2018, 41, 323-348.
Ben-Shaul, "OptiMouse: a comprehensive open source program for reliable detection and analysis of mouse body and nose positions," BMC Biology May 2017, 15(41), 1-22.
Chan et al., "Engineered AAVs for efficient noninvasive gene delivery to the central and peripheral nervous systems," Nature Neuroscience Jun. 2017, 20(8), 1172-1179.
Chen et al., "Near-infrared deep brain stimulation via upconversion nanoparticle-mediated optogenetics," Science Feb. 2018, 359, 679-684.
Deisseroth et al., "The form and function of channelrhodopsin," Science Sep. 2017, 357, 1-11.
Oda et al., "Crystal structure of the red light-activated channelrhodopsin Chrimson," Nature Communications Sep. 2018, 9(3949), 1-11.
Volkov et al., "Structural insights into ion conduction by channelrhodopsin 2," Science Nov. 2017, 358, 1-9.

\* cited by examiner

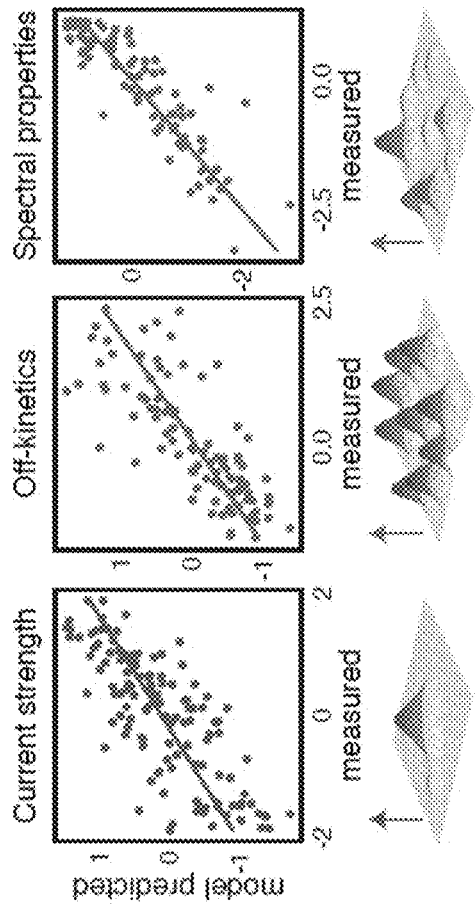
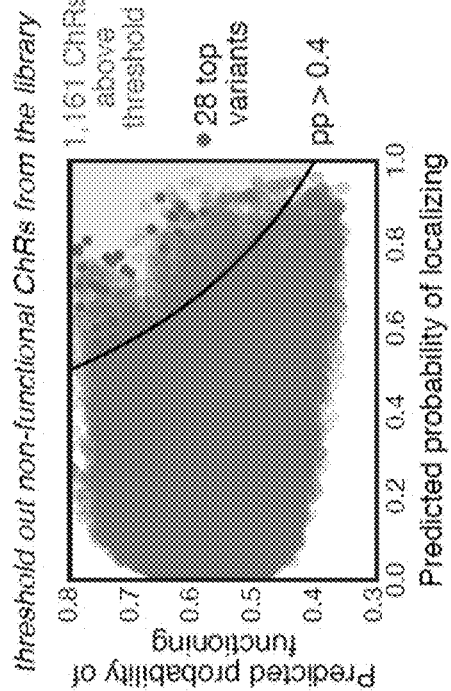
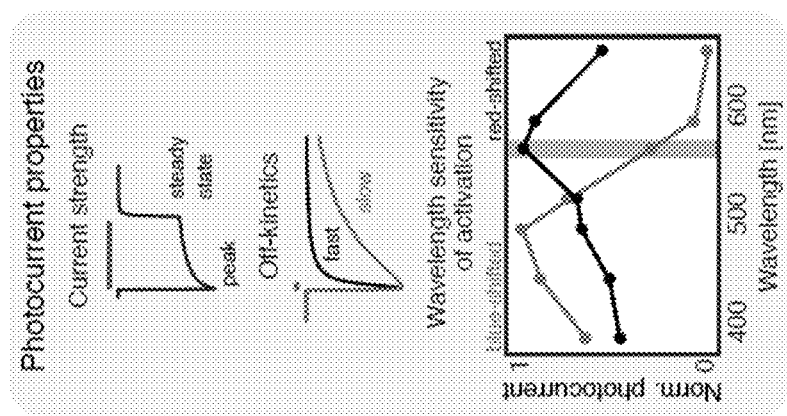

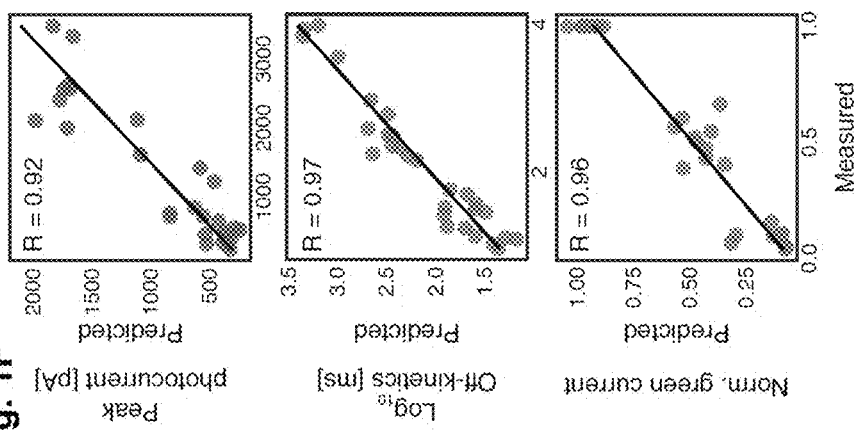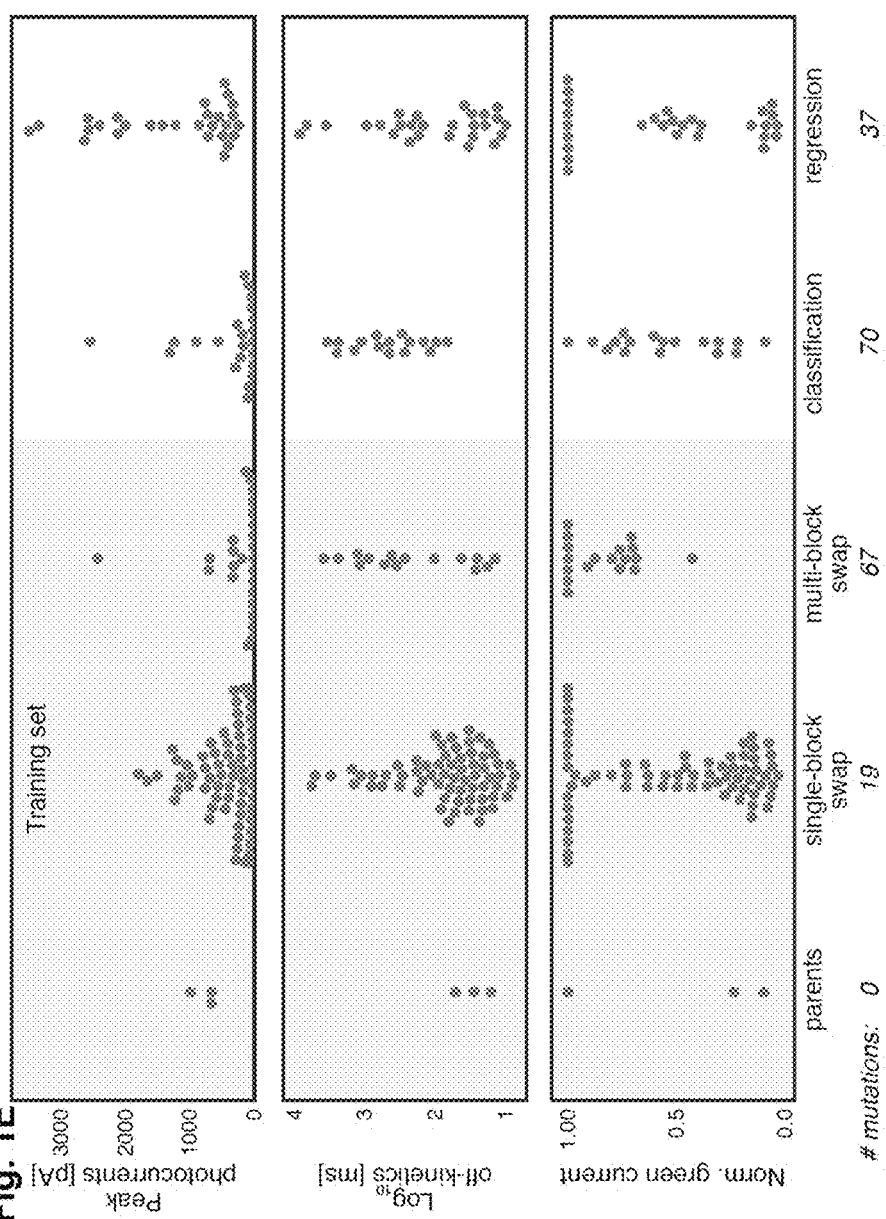

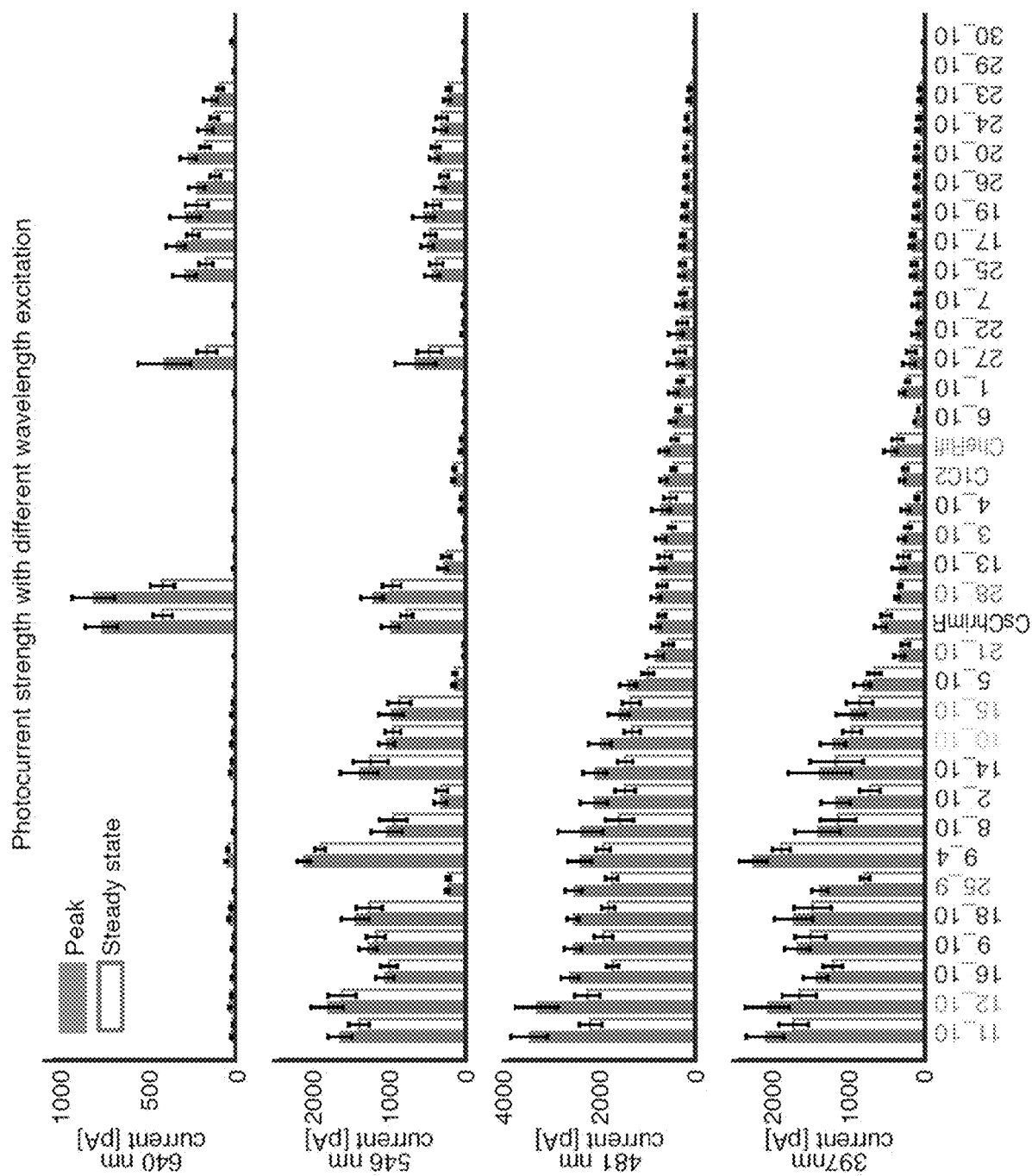

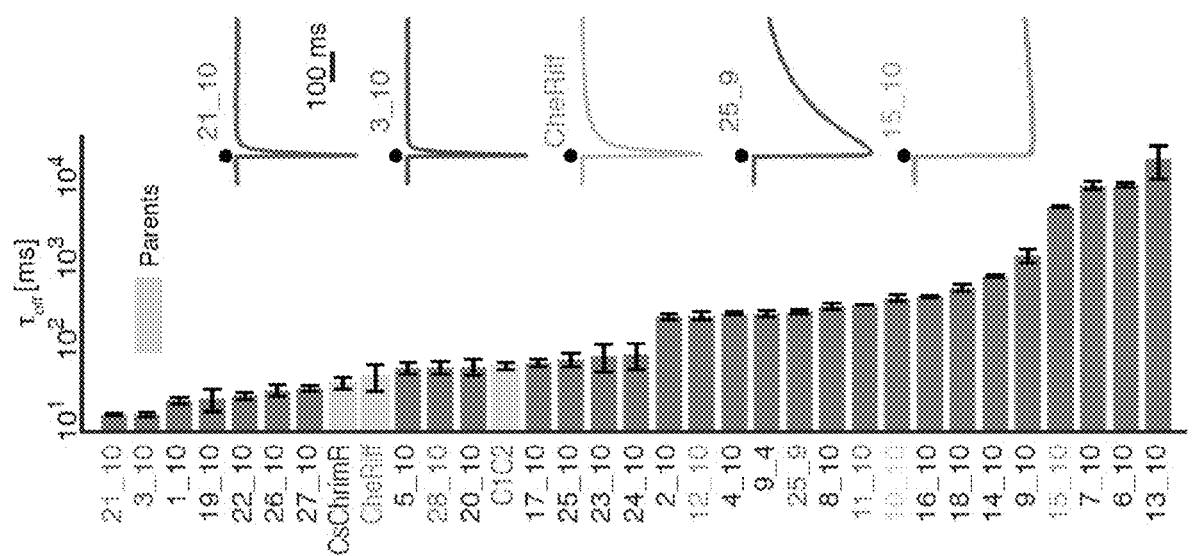

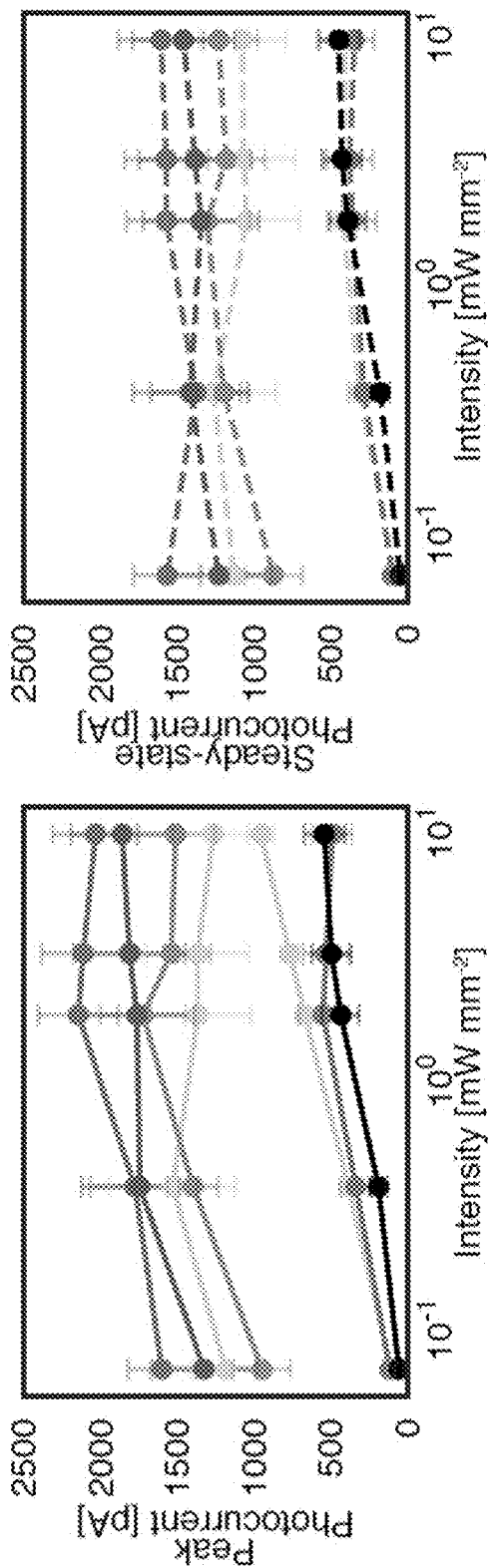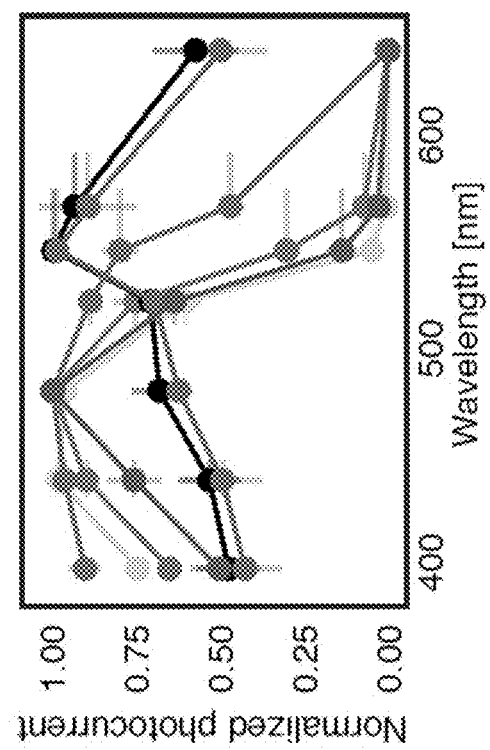

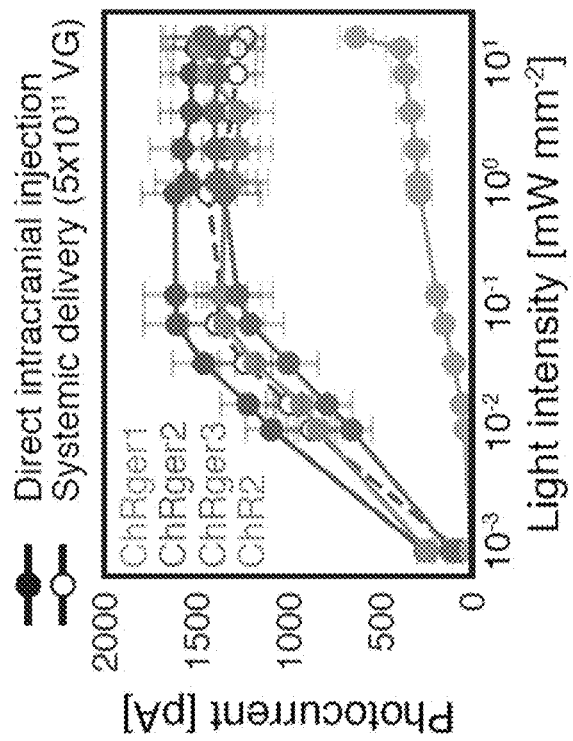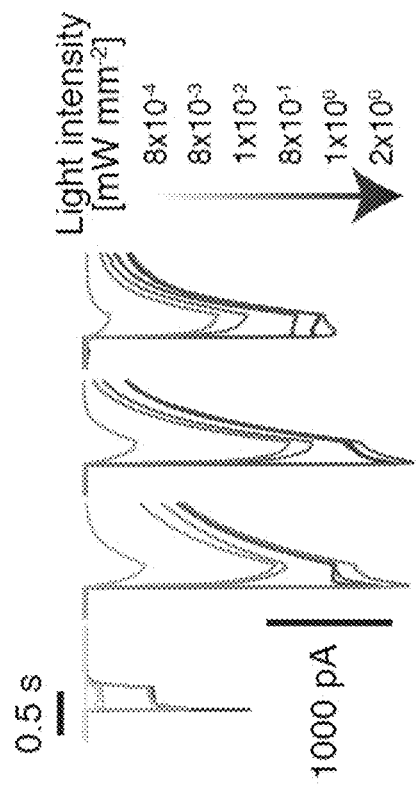

Fig. 7

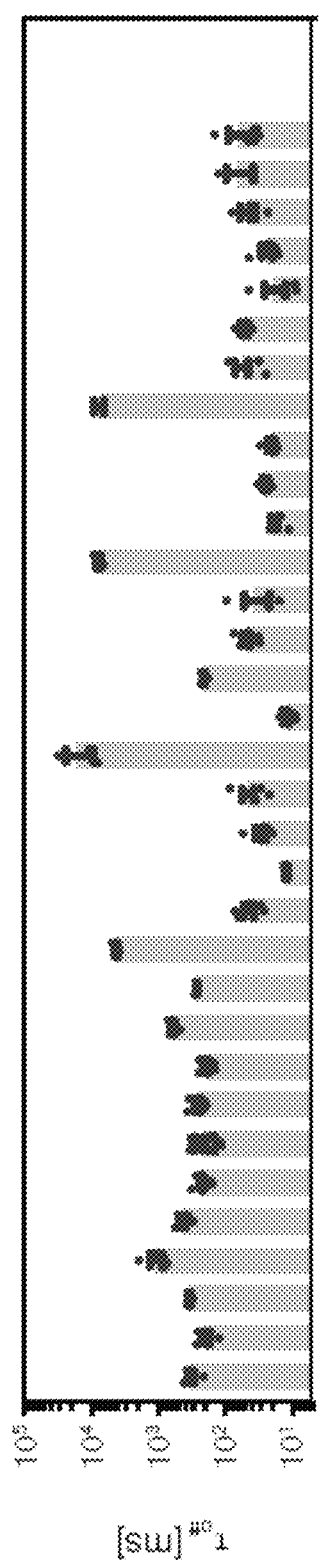
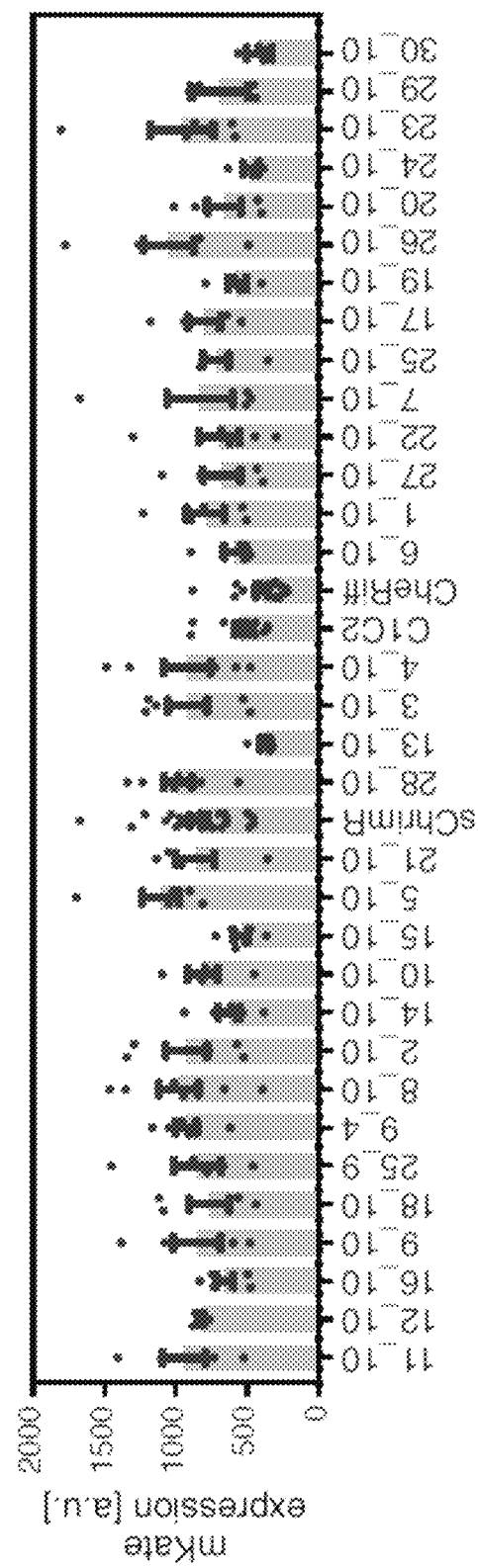
Fig. 11B
Fig. 11C

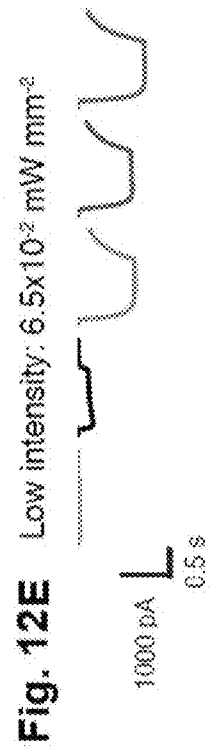
Fig. 12D  High intensity: 2.2 mW mm⁻²
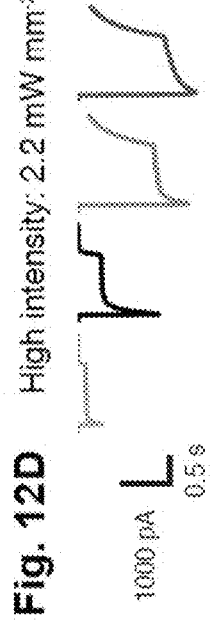
Fig. 12E  Low intensity: 6.5×10⁻² mW mm⁻²
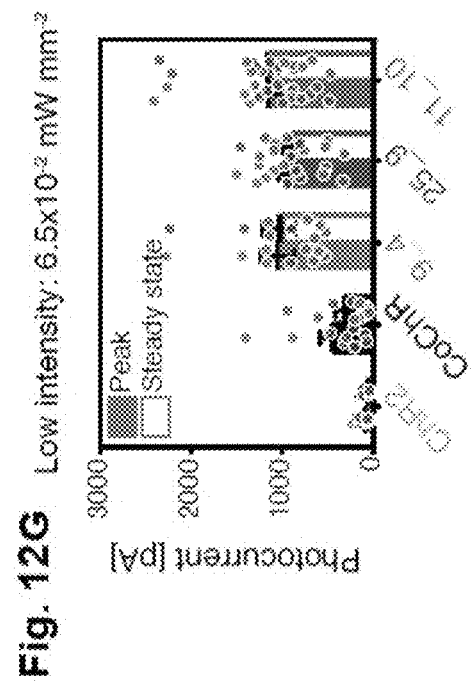
Fig. 12F  High intensity: 2.2 mW mm⁻²
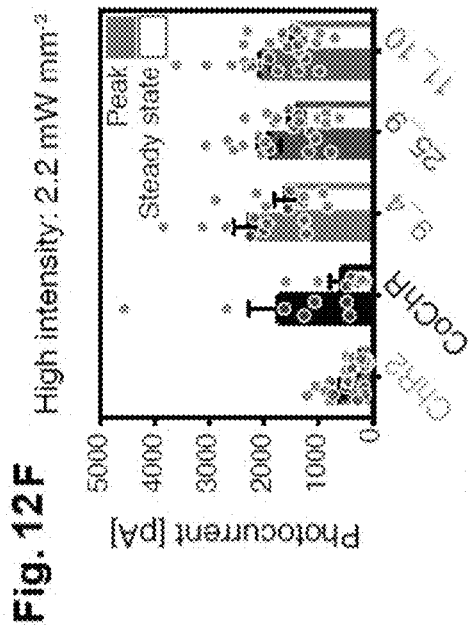
Fig. 12G  Low intensity: 6.5×10⁻² mW mm⁻²
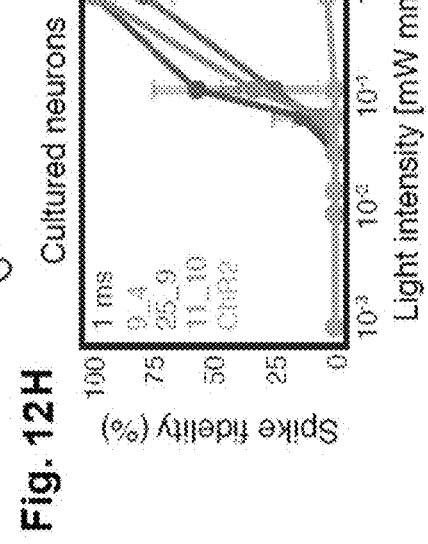
Fig. 12H  Cultured neurons

Fig. 13B

ENGINEERED LIGHT-SENSITIVE PROTEINS

RELATED APPLICATIONS

The present application claims priority under 35 U.S.C. § 119(e) to U.S. Provisional Application No. 62/732,953, filed on Sep. 18, 2018. The content of this related application is herein expressly incorporated by reference in its entirety.

STATEMENT REGARDING FEDERALLY SPONSORED R&D

This invention was made with government support under Grant No(s). MH103824 and MH102913 awarded by the National Institutes of Health. The government has certain rights in the invention.

REFERENCE TO SEQUENCE LISTING

The present application is being filed along with a Sequence Listing in electronic format. The Sequence Listing is provided as a file entitled 30KJ-300663-US_Sequence-Listing.txt, created Sep. 17, 2019, which is 1.28 MB in size. The information in the electronic format of the Sequence Listing is incorporated herein by reference in its entirety.

BACKGROUND

Field

The present application relates generally to the field of protein engineering and the uses of the engineered proteins. More particularly, the application relates to engineered light-sensitive proteins (for example, channelrhodopsins), the methods and compositions for expressing the engineered proteins, and the uses of the engineered proteins.

Description of the Related Art

Ocular disorders, such as inherited and age-related retinal degenerative diseases, can cause progressive loss of rod and cone photoreceptors, leading to partial or complete vision loss. Optogenetic techniques can be used to enable robust light-dependent neuronal activation and light-dependent behavioral control despite loss of the light-sensing cells required for vision. Current optogenetic approaches have various limitations, for example, low light-sensitivity in microbial opsins and chemically engineered mammalian receptors, and very slow kinetics in retinal opsins. There is a need in the art for improved optogenetic approaches to treating ocular disorders.

SUMMARY

Provided herein include recombinant or synthetic light-sensitive proteins. The recombinant or synthetic light-sensitive protein can comprise an amino acid sequence having at least 80% sequence identity to an amino acid sequence selected from the group consisting of SEQ ID NOs: 5-139, 141-147, and 149-196. In some embodiments, the light-sensitive protein comprises an amino acid sequence having at least 95% sequence identity to an amino acid sequence selected from the group consisting of SEQ ID NOs: 5-139, 141-147 and 149-196. In some embodiments, the light-sensitive protein comprises an amino acid sequence selected from the group consisting of SEQ ID NOs: 93, 109, 125-130, 132, 133, 136-138, 142, 146, 149, 150, and 155-196. In some embodiments, the light-sensitive protein comprises an amino acid sequence having at least 95% sequence identity to an amino acid sequence selected from the group consisting of SEQ ID NOs: 178-196. In some embodiments, the light-sensitive protein has at least two-fold improvement in light sensitivity, ion conductance or both, as compared to a channelrhodopsin consisting of the amino acid sequence of SEQ ID NO: 1, 3, 4, 155, 156, 176, or 177.

Described herein include nucleic acid molecules comprising nucleotide sequences encoding any one or more of the recombinant or synthetic light-sensitive proteins. In some embodiments, the nucleic acid molecule is a recombinant expression vector, for example a viral vector. The viral vector can be, for example, an adeno-associated viral vector, a lentiviral vector, a herpes simplex virus vector, or a retroviral vector. In some embodiments, the nucleotide sequence is operably linked to a transcriptional control element. The transcriptional control element can be functional in a specific cell type, for example a photoreceptor cell. The photoreceptor cell can be, for example, a rod cell, a cone cell, a retinal cell, or a combination thereof. In some embodiments, the transcriptional control element is a retinal cell-specific promoter. In some embodiments, the transcriptional control element is a promoter, including but not limited to a synapsin promoter, a CAG promoter, a cytomegalovirus promoter (CMV) promoter, a grm6 promoter, a Pleiades promoter, a ChAT promoter, a V-glut promoter, a GAD promoter, a PV promoter, a somatostatin (SST) promoter, a neuropeptide Y (NPY) promoter, a VIP promoter, a red cone opsin promoter, rhodopsin promoter, a rhodopsin kinase promoter, vitelliform macular dystrophy 2 (VMD2) gene promoter, an interphotoreceptor retinoid-binding protein (IRBP) gene promoter, elongation factor-1 alpha (EF-1 alpha) promoter, and a combination thereof.

Also disclosed herein include a cell, comprising: (a) any one or more of the recombinant or synthetic light-sensitive proteins disclosed herein; (b) a nucleic acid molecule comprising a nucleotide sequence encoding the one or more of the recombinant or synthetic light-sensitive proteins; or both. In some embodiments, the cell is a mammalian cell. In some embodiments, the cell is a rod cell, a cone cell, or a retina cell. The cell can be, for example, a neuronal cell or an electrically active cell. In some embodiments, the cell is a recombinant host cell, for example a mammalian cell, a non-human mammalian cell, a bacterial cell, a yeast cell, an insect cell, a plant cell, or a combination thereof.

Disclosed herein include a composition, comprising (i) any one or more of the recombinant or synthetic light-sensitive protein disclosed herein; (ii) a nucleic acid molecule comprising a nucleotide sequence encoding the one or more of the recombinant or synthetic light-sensitive proteins; (ii) a cell comprising: (a) any one or more of the recombinant or synthetic light-sensitive proteins disclosed herein, (b) a nucleic acid molecule comprising a nucleotide sequence encoding the one or more of the recombinant or synthetic light-sensitive proteins, or both; or any combination thereof. The composition can be, for example, a pharmaceutical composition comprising one or more pharmaceutically acceptable excipient.

Also disclosed herein include a method for expressing a light-sensitive protein in a subject in need thereof. In some embodiments, the light-sensitive protein comprises an amino acid sequence having at least 80% sequence identity to SEQ ID NOs: 1-139, 141-147 and 149-196. In some embodiments, the light-sensitive protein comprising an amino acid sequence selected from the group consisting of SEQ ID NOs: 93, 109, 125-130, 132, 133, 136-138, 142, 146, 149, 150, and 155-196. In some embodiments, the light-sensitive protein comprises an amino acid sequence having at least 95% sequence identity to an amino acid sequence selected from the group consisting of SEQ ID NOs: 178-196. In some embodiments, the light-sensitive protein has at least two-fold improvement in light sensitivity, ion conductance or both, as compared to a ChR consisting of the amino acid sequence of SEQ ID NO: 1, 3, 4, 155, 156, 176, or 177.

The subject in need thereof can, for example, be a subject suffering from or at a risk of developing an ocular disorder and expressing the light-sensitive protein treats or ameliorates the ocular disorder. Non-limiting examples of ocular disorders include retinitis pigmentosa, macular degeneration, retinoschisis, and Leber's Congenital Amaurosis, diabetic retinopathy, albinism, aniridia, colorblindness, corneal dystrophies, glaucoma, keratoconus, Leber congenital amaurosis, night blindness, retinoblastoma, and any combination thereof. In some embodiments, expressing the light-sensitive protein comprises administering to the subject a recombinant expression vector comprising a nucleotide sequence encoding the light-sensitive protein. The recombinant expression vector can be, for example, a viral vector.

In some embodiments, the administering is via intraocular injection, intravitreal injection, subretinal injection, intravenous delivery, or any combination thereof. In some embodiments, administering to the subject the recombinant expression vector comprises injecting the vector into the lateral geniculate nucleus of the subject. Injecting the vector into the lateral geniculate nucleus of the subject can, for example, comprise injecting the vector into two or more locations of the lateral geniculate nucleus of the subject.

In some embodiments, the subject is provided with a visual prosthesis before, at the same time as, or after delivery of said vector; and optionally the visual prosthesis is a retinal implant, a cortical implant, a lateral geniculate nucleus implant, or an optic nerve implant. In some embodiments, the method comprises exposing the visual cortex of the subject to light signals. In some embodiments, expressing the light-sensitive protein in the subject restores or enhances the visual function in the subject. In some embodiments, expressing the light-sensitive protein in the subject restores or enhances the photosensitivity of the retinal neurons in the subject, and/or the photosensitivity of a retina or a portion thereof of the subject.

In some embodiments, the light-sensitive protein is expressed in one or more cells selected from the group consisting of retinal cells, monocular neuronal cells, binocular neuronal cells, electrically active cells, and any combination thereof in the subject. In some embodiments, the one or more retinal cells comprises retinal ganglion cells, retinal neurons or any combination thereof.

In some embodiments, the subject suffers from blindness or vision loss, and optionally the blindness or visional loss is a result of a degenerative disease. In some embodiments, one or more photoreceptor cells of the subject are degenerating or have degenerated. In some embodiments, the subject in need thereof is a subject suffered and/or is suffering from retinal detachment and/or photoreceptor loss due to trauma or head injury.

The subject can be a living animal, for example a living mammal. In some embodiments, the subject is a human. The age and/or gender of the subject can vary. For example, the subject can be a minor, a senior, a female, or a male.

In some embodiments, the method comprises delivering light to the subject, and optionally delivery light comprises placing a plurality of fiber optic-cables on the skull of the subject. In some embodiments, the light activates the light-sensitive protein, thereby activating light-dependent neuronal cells in the subject. In some embodiments, the method comprises effecting light-controlled neuronal activation and/or light-induced behavioral control in the subject. In some embodiments, the method comprises effecting light-controlled neuronal activation and/or light-induced behavioral control in the subject.

BRIEF DESCRIPTION OF THE DRAWINGS

The patent or application file contains at least one drawing executed in color. Copies of this patent or patent application publication with drawing(s) will be provided by the Office upon request and payment of the necessary fee.

FIGS. 1A-F show machine learning-guided optimization of channelrhodopsins (ChRs). FIG. 1A: upon light exposure, ChRs open and reach a peak inward current and then desensitize reaching a lower steady-state current. both peak and steady-state current were used as metrics for photocurrent strength. To evaluate ChR off-kinetics, the current decay rate ($\tau_{off}$) after a 1 ms light exposure and the time to reach 50% of the light-exposed current after light removal were used. As a metric for wavelength sensitivity of activation, the normalized photocurrent with green (546 nm) light, which easily differentiates blue-shifted ChRs (peak activation: ~450-480 nm) and red-shifted ChRs (peak activation: ~520-650 nm), were used. FIG. 1B: classification models were trained to predict whether ChRs would localize correctly to the plasma membrane and function (i.e., ChRs above the 0.4 threshold for the product of the predicted probabilities (pp) of localization and function). FIG. 1C: regression models were then trained to approximate the fitness landscape for each property of interest for the recombination library (inset show hypothetical fitness landscapes). FIGS. 1B-C: models were trained with photocurrent properties for each ChR in the training set (plots show 20-fold cross validation on the training set). Sequences predicted to localize and function by the classification models and predicted to have an optimized set of functional properties by the regression models were selected for further characterization, e.g., the 28 top variants. FIG. 1D: the classification model was trained with 102 recombination variants (described in Table 2) and 61 previously-published ChRs (described in Table 3) and the regression models were trained with 124 recombination variants. FIG. 1E shows measurements of training set ChR and model-predicted ChR, peak photocurrent, off-kinetics, and normalized green current (n=3-8 cells per variant). Each gray-colored point is a ChR variant. Training set data are shaded in blue. Mean number of mutations for each set is below the plots. FIG. 1F shows model predictions vs measured photocurrent property for each of the 28 engineered ChRs. R represents the Pearson correlation coefficient.

FIGS. 2A-E show that the model-predicted ChRs exhibit a large range of functional properties often far exceeding the parents. FIG. 2A shows representative current traces after 0.5 s light exposure for select engineered ChR variants with corresponding expression and localization in HEK cells. Vertical colored scale bar for each ChR current trace represents 500 pA, and horizontal scale bar represents 250 ms. The variant color presented in FIG. 2A is constant throughout panels. FIG. 2B shows measured peak and steady-state photocurrent with different wavelengths of light in HEK cells (n=4-8 cells). 397 nm light at 1.5 mW mm$^{-2}$, 481 nm light at 2.3 mW mm$^{-2}$, 546 nm light at 2.8 mW mm$^{-2}$, and 640 nm light at 2.2 mW mm$^{-2}$. FIG. 2C shows off-kinetics decay rate ($\tau_{off}$) following a 1 ms exposure to 481 nm light at 2.3 mW mm$^{-2}$ (n=4-8 cells, see Dataset 2). Parent ChRs are highlighted in light gray. Inset shows representative current traces with 1 ms light exposure for select ChRs revealing distinct profiles: ChR_21_10 turns off rapidly, ChR_25_9 and ChR_11_10 turn off more slowly, and ChR_15_10 exhibits little decrease in photocurrent 0.5 s after the light exposure. FIG. 2D shows peak and steady-state photocurrent strength with varying light irradiances compared with parental ChRs (CheRiff, n=5 cells; CsChrimR, n=5 cells; C1C2, n=4 cells; 28_10, n=5 cells; 11_10, n=5 cells; 25_9, n=5 cells). FIG. 2E shows wavelength sensitivity of activation for select ChRs compared with parental ChRs (CheRiff, n=6 cells; CsChrimR, n=5 cells; C1C2, n=4 cells; 11_10, n=6 cells; 12_10, n=7 cells; 25_9, n=5 cells; 10_10, n=4 cells). Top variants, ChR_9_4, ChR_25_9, and ChR_11_10 are also referred to as ChRger1, ChRger2, and ChRger3, respectively, herein. Plotted data are mean±SEM.

FIG. 3A shows that ChRs were cloned into an AAV vector with either the hSyn or CamKIIa promoter and packaged into rAAV-PHP.eB for expression in culture and in vivo. FIG. 3N shows representative voltage traces with blue light-driven (1 mW mm$^{-2}$) spiking at the indicated frequencies. vg, viral genomes. Plotted data are mean±SEM.

FIG. 4A shows systemic delivery of rAAV-PHP.eB packaged CAG-DIO ChRger2-TS-eYFP or ChR2 (H134R)-TS-eYFP (3×10$^{11}$ vg/mouse) into Dat-Cre animals coupled with fiber optic implantation above the VTA enabled blue light-induced intracranial self-stimulation (ten 5 ms laser pulses) exclusively with ChRger2 and not ChR2 (H134R) with varying light power and varying stimulation frequencies. ChRger2, n=4 animals; ChR2(H134R), n=4 animals. Images show fiber placement and opsin expression for ChR2(H134R) (top) and ChRger2 (bottom). FIG. 4B shows minimally-invasive, systemic delivery of rAAV-PHP.eB packaged CaMKIIa ChRger2-TS-eYFP or ChR2 (H134R)-TS-eYFP (5×10$^{11}$ vg/mouse) into wild type (WT) animals coupled with surgically secured fiber-optic cannula guide to the surface of the skull above the right M2 that had been thinned to create a level surface for the fiber-skull interface. Three weeks later, mice were trained to walk on a linear-track treadmill at fixed velocity. Coronal slices show expression throughout cortex with higher magnification image of M2 (inset) for ChR2(H134R) (left) and ChRger2 (right). Unilateral blue light stimulation of M2 induced turning behavior exclusively with ChRger2 and not ChR2 (H134R) (10 Hz stimulation with 5 ms 447 nm light pulses at 20 mW). ChRger2, n=5 animals; ChR2(H134R), n=5 animals. No turning behavior was observed in any animal with 10 Hz stimulation with 5 ms 671 nm light pulses (20 mW). Plotted data are mean±SEM. vg, viral genomes.

FIG. 5A shows comparison of contact maps generated from the C1C2 (3UG9), ChR2 (6EID), and C1Chrimson (5ZIH) structures. Contact maps are aligned to the C1C2 structure for comparison. The ChR2 contact map (blue) and C1Chrimson contact map (pink) are overlaid on top of the C1C2 contact map (black). Black C1C2 contacts visible under the ChR2 or C1Chrimson contacts indicate contacts that appear in C1C2 but not in ChR2 or C1Chrimson. Many of the contacts that appear in the C1C2 structure but are lacking in ChR2 and C1Chrimson are clustered at the N- and C-terminal regions of the protein that are not resolved in the ChR2 or C1Chrimson structure but are resolved in the C1C2 structure. There are also differing contacts spread throughout the structure. FIG. 5B shows that of the 1346 contacts in C1C2, there are 150 contacts that do not appear in C1Chrimson and 236 contacts that do not appear in ChR2. Of the 1182 contacts in ChR2, there are 72 contacts that do not appear in C1C2. Of the 1284 contacts in C1Chrimson, there are 88 contacts that do not appear in C1C2. FIGS. 5C-D shows prediction accuracy of models built with each contact map evaluated using (FIG. 5C) 20-fold cross validation of the training set and (FIG. 5D) a test set. Prediction accuracy was evaluated for regression models of ChR peak photocurrent, off-kinetics, and spectral properties. The test set for all regression models was the 28 ChR sequences predicted to have useful combinations of diverse properties. Accuracy of model predictions is evaluated by Pearson correlation.

FIG. 8A shows prediction accuracy of L1-regularized linear regression models to identify a limited set of residues and structural contacts that strongly influence ChR photocurrent strength, off-kinetics, and spectral properties (20-fold cross validation). R represents the Pearson correlation coefficient. The position of specific residues (amino-acid sticks) and contacts (dark gray lines) most important for model prediction of (FIG. 8B) off-kinetics, photocurrent strength, and (FIG. 8C) red- or blue-shifted light sensitivity overlaid on the C1C2 crystal structure in light gray (3UG9.pdb). Specific residues and contacts are included in Dataset 4. Residues are colored according to the sign of their weighting (determined by L2-regularized linear regression). For example, residues highlighted in light green have a large positive weight from the photocurrent model and thus contribute to high photocurrents, while residues highlighted in dark teal have a large negative weight and thus contribute to low photocurrents. The seven transmembrane helices (TM1-7) are labeled (FIG. 8D). Zooming in to a number of heavily weighted residues for photocurrent strength, off-kinetics, and red- and blue-shifted light sensitivity. Relevant residues are labeled with amino acid numbering according to the C1C2 sequence. Contact lines between residues in FIG. 8D have been removed for clarity. Residue coloring in FIG. 8D follows the convention presented in FIGS. 8B and 8C).

FIG. 9A shows normalized output spectra for each light color used in this study to activate ChR photocurrents. The dashed line indicates the half maximum amplitude of the excitation spectra. FIG. 9B shows activation spectra for selected engineered ChR variants (CheRiff, n=6 cells; CsChrimR, n=5 cells; C1C2, n=4 cells; 11_10, n=6 cells; 12_10, n=7 cells; 25_9, n=5 cells; 10_10, n=4 cells). The y-axis error bars show full-width at half the maximum amplitude of the excitation spectra for each color.

FIGS. 11A-C show that model-predicted ChRs exhibit a large range of functional properties often far exceeding the parents. FIGS. 11A-C show data depicted in FIG. 2 with ChR properties (photocurrent strength, off-kinetics, and expression level) aligned for each ChR variant for easy comparison. In all plots, each point is an individual cell. FIG. 11A shows peak photocurrent of engineered ChRs with different activation wavelengths in HEK cells (n=4-8 cells). 397 nm light at 1.5 mW mm$^{-2}$, 481 nm light at 2.3 mW mm$^{-2}$, 546 nm light at 2.8 mW mm$^{-2}$, and 640 nm light at 2.2 mW mm$^{-2}$. FIG. 11B shows off-kinetics decay rate ($\tau_{off}$) following a 1 ms exposure to 481 nm light at 2.3 mW mm$^{-2}$ (n=4-8 cells). FIG. 11C shows expression of engineered ChRs measured by the mKate fusion fluorescence level (n=4-8 cells). Plotted data are mean±SEM.

FIGS. 12A-H show that some engineered ChR variants outperformed the commonly used ChR2(H134R) and the high performance CoChR. FIG. 12A shows construct design for each ChR tested with a TS sequence, eYFP, and WPRE under the hSyn promoter. Representative cells show expression and localization of each ChR variant. FIG. 12B shows expression of ChR-eYFP for each ChR construct. FIG. 12C shows photocurrent strength versus expression in HEK cells for each ChR variant. Each point is an individual cell. ChR2(H134R), n=10 cells; CoChR, n=7 cells; ChR_9_4, n=9 cells; ChR_25_9, n=13 cells; ChR_11_10, n=16 cells. FIGS. 12D-E shows representative current traces after 1 s light exposure for ChR variants with (FIG. 12D) high-intensity (2.2 mW mm$^{-2}$) and (FIG. 12E) low-intensity (6.5×10$^{-2}$ mW mm$^{-2}$) 481 nm light. FIGS. 12F-G shows peak and steady-state photocurrent comparison with (FIG. 11F) high-intensity and (FIG. 12G) low-intensity 481 nm light. Engineered ChR variants produce significantly larger steady-state photocurrents than CoChR (Kruskal-Wallis test with Dunn's post hoc test; Table 9). ChR2(H134R), n=11 cells; CoChR, n=7 cells; ChR_9_4, n=9 cells; ChR_25_9, n=12 cells; ChR_11_10, n=16 cells. FIG. 12H shows spike fidelity with varying intensity light of ChR variants at 2 Hz stimulation in cultured neurons with 1 ms light-pulse width (ChR_9_4, n=6 cells; ChR_25_9, n=4 cells; ChR_11_10, n=6 cells; ChR2, n=7 cells). Plotted data are mean±SEM and each point is an individual cell.

FIG. 13A shows five engineered ChRs predicted by the machine-learning models aligned with the three parents and the ChR secondary structure. (*) highlights the Schiff base. Blocks of ChR chimeras are colored according to which parent each block came from. CsChrimR is red, CheRiff is blue, and C1C2 is green. FIG. 13B shows sequence alignment between parents (C1C2: SEQ ID No: 155. SpyTag-CheRiff: SEQ ID NO:4; SpyTag-C1C2: SEQ ID NO: 1; and SpyTag-CsChrim: SEQ ID NO: 3) and five engineered ChRs (ChR_10_10: SEQ ID No: 129; ChRger3 (ChR_11_10): SEQ ID NO: 136; ChR_12_10: SEQ ID NO: 125; ChRger2 (ChR_25_9): SEQ ID NO: 109; and ChRger1 (ChR_9_4): SEQ ID NO: 92) was created using ClustalΩ and visualized using ENDscript. Secondary structure elements for C1C2 are shown as coils (α: α-helices) and arrows (β-strands). "TT" represents turns. Identical and conservatively substituted residues are highlighted in red (outlined in blue box). The lysine residue involved in the Schiff base is highlighted in yellow shading. The SpyTag sequence is highlighted in light blue shading.

DETAILED DESCRIPTION

Figure 1D:
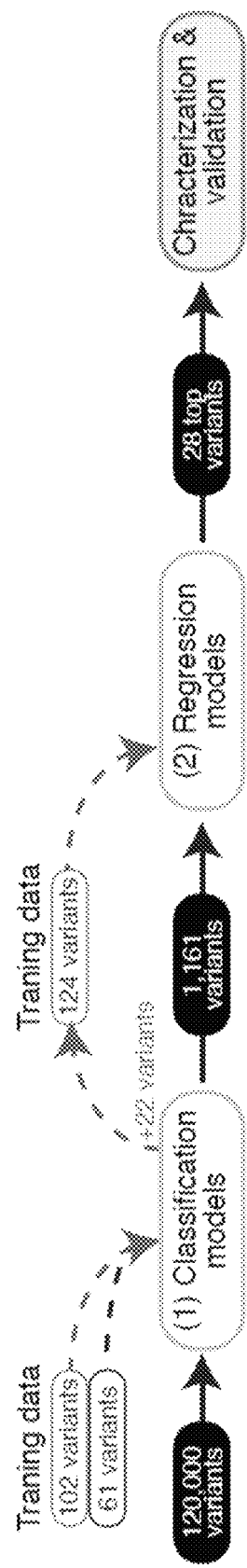

In the following detailed description, reference is made to the accompanying drawings, which form a part hereof. In the drawings, similar symbols typically identify similar components, unless context dictates otherwise. The illustrative embodiments described in the detailed description, drawings, and claims are not meant to be limiting. Other embodiments may be utilized, and other changes may be made, without departing from the spirit or scope of the subject matter presented herein. It will be readily understood that the aspects of the present disclosure, as generally described herein, and illustrated in the Figures, can be arranged, substituted, combined, separated, and designed in a wide variety of different configurations, all of which are explicitly contemplated herein and make part of this disclosure The present application provides recombinant or synthetic light-sensitive proteins with improved properties, such as improvement in light sensitivity, ion conductance, or both. Also provided herein include nucleic acid molecules comprising coding sequences for the light-sensitive proteins; cells comprising the light-sensitive proteins, the nucleic acid molecules comprising the coding sequence for the light-sensitive proteins, or both; and compositions comprises the proteins, the nucleic acid molecules, the cells, or any combination thereof. Methods for expressing a light-sensitive protein in a subject are also provided. The methods can be used, for example, treating or ameliorating ocular disorders and neuronal disorders, restoring or enhancing the visual function of the subject, restoring or enhancing the photosensitivity of the retinal neurons in the subject, restoring or enhancing the photosensitivity of a retina or a portion thereof of the subject; treating or ameliorating blindness or vision loss caused by retinal detachment and/or photoreceptor loss due to trauma or head injury. The method can also be used to effect light-controlled neuronal activation in the subject, or to control light-induced behaviors for the subject.

Definitions

Unless defined otherwise, technical and scientific terms used herein have the same meaning as commonly understood by one of ordinary skill in the art to which the present disclosure belongs. See, e.g. Singleton et al., Dictionary of Microbiology and Molecular Biology 2nd ed., J. Wiley & Sons (New York, NY 1994); Sambrook et al., Molecular Cloning, A Laboratory Manual, Cold Springs Harbor Press (Cold Springs Harbor, NY 1989). For purposes of the present disclosure, the following terms are defined below.

As used herein, the term "vector," can refer to a vehicle for carrying or transferring a nucleic acid. Non-limiting examples of vectors include viral vectors (for example, adenovirus vectors, adeno-associated virus (AAV) vectors, retrovirus vectors, lentiviral vectors, herpes virus vectors, phages, and poxvirus vectors); non-viral vectors such as liposomes, naked DNA, plasmids, cosmids; and the like.

As used herein, the term "construct," refers to a recombinant nucleic acid that has been generated for the purpose of the expression of a specific nucleotide sequence(s), or that is to be used in the construction of other recombinant nucleotide sequences.

As used herein, the term "plasmid" refers to a nucleic acid that can be used to replicate recombinant DNA sequences within a host organism. The sequence can be a double stranded DNA.

As used herein, the terms "nucleic acid" and "polynucleotide" are interchangeable and refer to any nucleic acid, whether composed of phosphodiester linkages or modified linkages such as phosphotriester, phosphoramidate, siloxane, carbonate, carboxymethylester, acetamidate, carbamate, thioether, bridged phosphoramidate, bridged methylene phosphonate, bridged phosphoramidate, bridged methylene phosphonate, phosphorothioate, methylphosphonate, phosphorodithioate, bridged phosphorothioate or sultone linkages, and combinations of such linkages. The terms "nucleic acid" and "polynucleotide" also specifically include nucleic acids composed of bases other than the five biologically occurring bases (adenine, guanine, thymine, cytosine and uracil).

The term "element" refers to a separate or distinct part of something, for example, a nucleic acid sequence with a separate function within a longer nucleic acid sequence. The terms "transcription regulatory element" and "expression control element" are used to refer to nucleic acid molecules that can influence the expression (including at the transcription and/or translation level) of an operably linked coding sequence in a specific host organism. These terms are used broadly to and cover all elements that promote or regulate transcription, including promoters, core elements required for basic interaction of RNA polymerase and transcription factors, upstream elements, enhancers, and response elements (see, e.g., Lewin, "Genes V" (Oxford University Press, Oxford) pages 847-873). Exemplary regulatory elements in prokaryotes include promoters, operator sequences and ribosome binding sites. Regulatory elements that are used in eukaryotic cells can include, without limitation, transcriptional and translational control sequences, such as promoters, enhancers, splicing signals, polyadenylation signals, terminators, protein degradation signals, internal ribosome-entry element (IRES), 2A sequences, and the like, that provide for and/or regulate expression of a coding sequence and/or production of an encoded polypeptide in a host cell. The promoter can be a specific promoter, e.g., cell type-specific and/or tissue-specific. The promoter can be constituent or inducible (e.g., by chemical agent, biological agent, temperature, and/or pH).

As used herein, the term "variant" refers to a polynucleotide or polypeptide having a sequence substantially similar to a reference (e.g., the parent) polynucleotide or polypeptide. In the case of a polynucleotide, a variant can have deletions, substitutions, additions of one or more nucleotides at the 5' end, 3' end, and/or one or more internal sites in comparison to the reference polynucleotide. Similarities and/or differences in sequences between a variant and the reference polynucleotide can be detected using conventional techniques known in the art, for example polymerase chain reaction (PCR) and hybridization techniques. Variant polynucleotides also include synthetically derived polynucleotides, such as those generated, for example, by using site-directed mutagenesis. Generally, a variant of a polynucleotide, including, but not limited to, a DNA, can have at least, or at least about, 50%, 55%, 60%, 65%, 70%, 75%, 80%, 85%, 90%, 91%, 92%, 93%, 94%, 95%, 96%, 97%, 98%, 99%, or more sequence identity to the reference polynucleotide as determined by sequence alignment programs known in the art. In the case of a polypeptide, a variant can have deletions, substitutions, additions of one or more amino acids in comparison to the reference polypeptide. Similarities and/or differences in sequences between a variant and the reference polypeptide can be detected using conventional techniques known in the art, for example Western blot. A variant of a polypeptide can have, for example, at least, or at least about, 60%, 65%, 70%, 75%, 80%, 85%, 90%, 91%, 92%, 93%, 94%, 95%, 96%, 97%, 98%, 99%, or more sequence identity to the reference polypeptide as determined by sequence alignment programs known in the art.

The term "AAV" or "adeno-associated virus" refers to a Dependoparvovirus within the Parvoviridae genus of viruses.

Unless specified otherwise, the left-hand end of any single-stranded polynucleotide sequence discussed herein is the 5' end; the left-hand direction of double-stranded polynucleotide sequences is referred to as the 5' direction.

The term "naturally occurring" as used herein refers to materials which are found in nature or a form of the materials that is found in nature.

Standard techniques can be used for recombinant DNA, oligonucleotide synthesis, and tissue culture and transformation (e.g., electroporation, lipofection). Enzymatic reactions and purification techniques can be performed according to manufacturer's specifications or as commonly accomplished in the art or as described herein. The foregoing techniques and procedures can be generally performed according to conventional methods well known in the art and as described in various general and more specific references that are cited and discussed throughout the present specification. See, e.g., Sambrook et al., Molecular Cloning: A Laboratory Manual (2d ed., Cold Spring Harbor Laboratory Press, Cold Spring Harbor, N.Y. (1989)), which is incorporated herein by reference for any purpose. Unless specific definitions are provided, the nomenclatures utilized in connection with, and the laboratory procedures and techniques of, analytical chemistry, synthetic organic chemistry, and medicinal and pharmaceutical chemistry described herein are those commonly known and used in the art. Standard techniques can be used for chemical syntheses, chemical analyses, pharmaceutical preparation, formulation, and delivery, and treatment of patients.

As used herein, a "subject" refers to an animal that is the object of treatment, observation or experiment. "Animal" includes cold- and warm-blooded vertebrates (e.g., mammals) and invertebrates (e.g., fish, shellfish and reptiles). "Mammal," as used herein, refers to an individual belonging to the class Mammalia and includes, but not limited to, humans, domestic and farm animals, zoo animals, sports and pet animals. Non-limiting examples of mammals include mice; rats; rabbits; guinea pigs; dogs; cats; sheep; goats; cows; horses; primates, such as monkeys, chimpanzees, apes, and humans. In some embodiments, the subject is a human. However, in some embodiments, the subject is not a human.

As used herein, the term "treatment" refers to an intervention made in response to a disease, disorder or physiological condition manifested by a patient, particularly a patient suffering from one or more serotonin-related diseases. The aim of treatment may include, but is not limited to, one or more of the alleviation or prevention of symptoms, slowing or stopping the progression or worsening of a disease, disorder, or condition and the remission of the disease, disorder or condition. The term "treat" and "treatment" includes, for example, therapeutic treatments, prophylactic treatments, and applications in which one reduces the risk that a subject will develop a disorder or other risk factor. Treatment does not require the complete curing of a disorder and encompasses embodiments in which one reduces one or more symptoms of the disorder and/or underlying risk factors. In some embodiments, "treatment" refers to both therapeutic treatment and prophylactic or preventative measures. Those in need of treatment include those already affected by a disease or disorder or undesired physiological condition as well as those at a risk of developing the disease or disorder, and those in which the disease or disorder or undesired physiological condition is to be prevented. For example, in some embodiments treatment may enhance or reduce the level of serotonin in the subject, thereby to reduce, alleviate, or eradicate the symptom(s) of the disease(s). As used herein, the term "prevention" refers to any activity that reduces the burden of the individual later expressing those serotonin-related disease symptoms. This can take place at primary, secondary and/or tertiary prevention levels, wherein: a) primary prevention avoids the development of symptoms/disorder/condition; b) secondary prevention activities are aimed at early stages of the condition/disorder/symptom treatment, thereby increasing opportunities for interventions to prevent progression of the condition/disorder/symptom and emergence of symptoms; and c) tertiary prevention reduces the negative impact of an already established condition/disorder/symptom by, for example, restoring function and/or reducing any condition/disorder/symptom or related complications. The term "prevent" does not require the 100% elimination of the possibility of an event. Rather, it denotes that the likelihood of the occurrence of the event has been reduced in the presence of the compound or method.

As used herein, the term "effective amount" refers to an amount sufficient to effect beneficial or desirable biological and/or clinical results. As used herein, a "therapeutically effective amount" of a compound is an amount sufficient to provide any therapeutic benefit in the treatment or management of a disorder (e.g., a neuron mediated disorder or an ocular disorder), or to delay or minimize one or more symptoms associated with a disorder (e.g., a neuron mediated disorder or an ocular disorder). A therapeutically effective amount of an agent (e.g., a light-sensitive protein) refers to an amount of the agent, alone or in combination with one or more other therapies and/or therapeutic agents that provide any therapeutic benefit in the treatment or management of a disorder (e.g., a neuron mediated disorder or an ocular disorder). The term "therapeutically effective amount" can encompass an amount that alleviates a neuron mediated disorder or ocular disorder, improves or reduces the neuron mediated disorder or the ocular disorder, improves overall therapy, or enhances the therapeutic efficacy of another therapeutic agent.

"Pharmaceutically acceptable" carriers are ones which are nontoxic to the cell or mammal being exposed thereto at the dosages and concentrations employed. "Pharmaceutically acceptable" carriers can be, but not limited to, organic or inorganic, solid or liquid excipients which is suitable for the selected mode of application such as oral application or injection, and administered in the form of a conventional pharmaceutical preparation, such as solid such as tablets, granules, powders, capsules, and liquid such as solution, emulsion, suspension and the like. Often the physiologically acceptable carrier is an aqueous pH buffered solution such as phosphate buffer or citrate buffer. The physiologically acceptable carrier may also comprise one or more of the following: antioxidants including ascorbic acid, low molecular weight (less than about 10 residues) polypeptides, proteins, such as serum albumin, gelatin, immunoglobulins; hydrophilic polymers such as polyvinylpyrrolidone, amino acids, carbohydrates including glucose, mannose, or dextrins, chelating agents such as EDTA, sugar alcohols such as mannitol or sorbitol, salt-forming counterions such as sodium, and nonionic surfactants such as Tween™, polyethylene glycol (PEG), and Pluronics™ Auxiliary, stabilizer, emulsifier, lubricant, binder, pH adjustor controller, isotonic agent and other conventional additives may also be added to the carriers.

As used herein, the term "blindness" refers to total or partial loss of vision. The blindness can be caused by, for example, degeneration or non-functioning of photoreceptors caused by any diseases and conditions (e.g., physical injuries). In some embodiments, the blindness is associated with conditions such as glaucoma, late stage diabetic retinopathy, hereditary optic neuropathies, optic nerve injuries, and any combination thereof.

As used herein, the term "vision" refers to the ability of a subject to detect light as a stimulus for differentiation or action. Vision is intended to encompass the following: (1) light detection or perception, that is the ability to discern whether or not light is present; (2) light projection, that is the ability to discern the direction from which a light stimulus is coming; (3) resolution, that is the ability to detect differing brightness levels (i.e., contrast) in a grating or letter target; and (4) recognition, that is the ability to recognize the shape of a visual target by reference to the differing contrast levels within the target. Thus, "vision" encompasses the ability to simply detect the presence of light (for example red light), including light having a wavelength between about 365 nm and about 700 nm, between about 530 nm and about 640 nm. In some embodiments, a peak activation occurs upon contact with light having a wavelength of about 590 nm. In some embodiments, transfection of retinal neurons with a nucleic acid molecule (e.g. vector) encoding a light-sensitive protein disclosed herein provides retinal neurons, for example bipolar cells and/or ganglion cells, with photosensitive membrane channels. Thus, it is possible to measure, with a light stimulus, the transmission of a visual stimulus to the animal's visual cortex, the area of the brain responsible for processing visual signals which constitutes a form of vision, as intended herein.

As used herein, the term "retinal cell" can refer herein to any of the cell types that comprise the retina, such as retinal ganglion cells; amacrine cells; horizontal cells; bipolar cells; and photoreceptor cells including rods and cones.

As used herein, the terms "light sensitivity" and "photosensitivity" are used interchangeably and refer to a notable or increased reactivity to light.

Light-Sensitive Proteins

Engineered light-sensitive proteins, including channelrhodopsins (ChRs) with desirable current strength and light sensitivity, are provided. ChRs are light-gated ion channels found in photosynthetic algae. Transgenic expression of ChRs in the brain enables light-dependent neuronal activation. These channels are widely applied as tools in neuroscience research. For example, in the field of optogenetics, ChRs are expressed in neurons in different areas of the animal brain and then fiber-optic cables are implanted in the brain to deliver light directly to the areas of the brain of interest. Turning on the light activates the neurons in these areas. However, these channels have broad activation spectra in the visible range and require high-intensity light for activation [~1 mW mm$^2$]. ChRs are naturally low-conductance channels requiring approximately $10^5$-$10^6$ functional ChRs expressed in the plasma-membrane of a neuron to produce sufficient light-dependent depolarization to induce neuronal activation. When applied to the mouse brain, ChRs require ~1-15 mW light delivered ~100 μm from the target cell population to reliably activate action potentials. This confines light-dependent activation to a small volume of brain tissue [~1 mm$^3$] in conjunction of the requirement of intracranial surgery for transgene injection and implantation of invasive fiber-optic cables. Therefore, this is a highly invasive method for neuronal control with light. There is a need for enabling optogenetics for large brain volumes without the need to implant invasive optical fibers for light delivery, for example, the light delivery in neuroscience applications.

Novel and high-performance ChRs which can, for example, facilitate expansive optogenetics without the need for invasive implants, have been designed and produced, and are disclosed herein. For example, the engineered ChRs can have sufficient photocurrent strength and light sensitivity to enable minimally-invasive neuronal circuit interrogation in live organisms, and to avoid, for example, the need of intracranial surgery for transgene injection and implantation of invasive fiber-optic cables to produce light-dependent activation of brain and eye tissues. The high light sensitivity and ion conductance of the engineered ChRs allow these ChRs to be packaged and delivered non-invasively to desired locations and tissues using engineered viruses (e.g. rAAV-PHP.eB), and to be compatible with low per-cell transgene copy produced by systemic delivery (e.g., viral vector-based gene delivery intravenously). Coupled with non-invasive systemic delivery, the ChRs can be activated with light delivered through the skull of a live animal (by fiber optic-cables placed on the skull surface). In some embodiments, these high-conductance, high-sensitivity ChRs are used for robust light-dependent neuronal activation and light-dependent behavioral control.

Recombinant or synthetic light-sensitive proteins are disclosed herein. The light-sensitive protein can, for example, comprise, or consist of, an amino acid sequence having at least 80% sequence identity to an amino acid sequence of any of the ChR proteins disclosed herein (e.g., ChR proteins having an amino acid sequence of any one of SEQ ID NOs: 1-475), including but is not limited to, an amino acid sequence selected from the group consisting of SEQ ID NOs: 5-139, 141-147, and 149-196. In some embodiments, the light-sensitive protein comprises, or consists of, an amino acid sequence having, or having about, 80%, 81%, 82%, 83%, 84%, 85%, 86%, 87%, 88%, 89%, 90%, 91%, 92%, 93%, 94%, 95%, 96%, 97%, 97.5%, 98%, 98.5%, 99%, 99.5%, 100%, or a range between any two of these values, sequence identity to an amino acid sequence selected from the group consisting of SEQ ID NOs: 5-139, 141-147, and 149-196. In some embodiments, the light-sensitive protein comprises, or consists of, an amino acid sequence having at least, or at least about, 80%, 81%, 82%, 83%, 84%, 85%, 86%, 87%, 88%, 89%, 90%, 91%, 92%, 93%, 94%, 95%, 96%, 97%, 97.5%, 98%, 98.5%, 99%, 99.5%, sequence identity to an amino acid sequence selected from the group consisting of SEQ ID NOs: 5-139, 141-147, and 149-196. In some embodiments, the light-sensitive protein comprises or consists of an amino acid sequence selected from the group consisting of SEQ ID NOs: 5-139, 141-147, and 149-196. In some embodiments, the amino acid sequence of the light-sensitive protein is selected from the group consisting of SEQ ID NOs: 5-139, 141-147, and 149-196.

The light-sensitive protein can, for example, comprise, or consists of, an amino acid sequence having, or having about, one, two, three, four, five, six, seven, eight, nine, ten, eleven, twelve, thirteen, fourteen, fifteen, sixteen, seventeen, eighteen, nineteen, twenty, twenty-two, twenty-three, twenty-four, twenty-five, twenty-six, twenty-seven, twenty-eight, twenty-nine, thirty, or a range between any two of these values, mismatch compared to an amino acid sequence of any of the ChR proteins disclosed herein (e.g., ChR proteins having an amino acid sequence of any one of SEQ ID NOs: 1-475), including but is not limited to, an amino acid sequence selected from the group consisting of SEQ ID NOs: 5-139, 141-147, and 149-196. In some embodiments, the light-sensitive protein comprises, or consists of, an amino acid sequence having at most, or having at most about, one, two, three, four, five, six, seven, eight, nine, ten, eleven, twelve, thirteen, fourteen, fifteen, sixteen, seventeen, eighteen, nineteen, twenty, twenty-two, twenty-three, twenty-four, twenty-five, twenty-six, twenty-seven, twenty-eight, twenty-nine, thirty mismatches compared to an amino acid sequence selected from the group consisting of SEQ ID NOs: 5-139, 141-147, and 149-196.

In some embodiments, the recombinant or synthetic light-sensitive protein comprises, or consists of, an amino acid sequence having at least 95% sequence identity to an amino acid sequence selected from the group consisting of SEQ ID NOs: 93, 109, 125-130, 132, 133, 136-138, 142, 146, 149, 150, and 155-196. In some embodiments, the recombinant or synthetic light-sensitive protein comprises, or consists of, an amino acid sequence selected from the group consisting of SEQ ID NOs: 93, 109, 125-130, 132, 133, 136-138, 142, 146, 149, 150, and 155-196. In some embodiments, the recombinant or synthetic light-sensitive protein comprises, or consists of, an amino acid sequence having at most, or having at most about, one, two, three, four, five, six, seven, eight, nine, ten, eleven, twelve, thirteen, fourteen, fifteen, sixteen, seventeen, eighteen, nineteen, twenty, twenty-two, twenty-three, twenty-four, twenty-five, twenty-six, twenty-seven, twenty-eight, twenty-nine, thirty mismatches compared to SEQ ID NOs: 93, 109, 125-130, 132, 133, 136-138, 142, 146, 149, 150, and 155-196. In some embodiments, the recombinant or synthetic light-sensitive protein comprises, or consists of, an amino acid sequence having, or having about, one, two, three, four, five, six, seven, eight, nine, ten, eleven, twelve, thirteen, fourteen, fifteen, sixteen, seventeen, eighteen, nineteen, twenty, or a range between any two of these values, mismatches compared to SEQ ID NOs: 93, 109, 125-130, 132, 133, 136-138, 142, 146, 149, 150, and 155-196.

In some embodiments, the recombinant or synthetic light-sensitive protein is a ChR comprising, or consisting of, an amino acid sequence having at least 95% sequence identity to an amino acid sequence selected from the group consisting of SEQ ID NOs: 178-196. In some embodiments, the recombinant or synthetic light-sensitive protein is a ChR comprising, or consisting of, an amino acid sequence selected from the group consisting of SEQ ID NOs: 178-196. In some embodiments, the recombinant or synthetic light-sensitive protein comprises, or consists of, an amino acid sequence having, or having about, one, two, three, four, five, six, seven, eight, nine, ten, eleven, twelve, thirteen, fourteen, fifteen, or a range between any two of these values, mismatches compared to SEQ ID NOs: 178-196.

In some embodiments, the light-sensitivity protein does not comprise, or is not consisted of, an amino acid sequence selected from SEQ ID NOs: 140, 148, 170, 173, 191, and 194. In some embodiments, the light-sensitivity protein does not comprise, or is not consisted of, an amino acid sequence having at least, or at least about, 90%, 91%, 92%, 93%, 94%, 95%, 95.5%, 96%, 96.5%, 97%, 97.5%, 98%, 98.5%, 99%, 99.5%, or more, sequence identity to SEQ ID NOs: 140, 148, 170, 173, 191, and 194. In some embodiments, the light-sensitivity protein does not comprise, or is not consisted of, an amino acid sequence having 90%, 91%, 92%, 93%, 94%, 95%, 95.5%, 96%, 96.5%, 97%, 97.5%, 98%, 98.5%, 99%, 99.5%, or a range of any two of these values, sequence identity to SEQ ID NOs: 140, 148, 170, 173, 191, and 194.

The recombinant or synthetic light-sensitive protein can be better in one or more functional properties (e.g., higher light sensitivity, photocurrent strength, ion conductance, light-induced firing, plasma membrane localization, and spectra properties) than a reference ChR. The reference ChR can be, for example, C1C2, CsChrim, CheRiff, and/or any one of the ChRs having the amino acid sequence of SEQ ID NO: 1, 3, 4, 155, 156, 176, or 177. The extent of which the recombinant or synthetic light-sensitive protein is higher in one or more of light sensitivity, ion conductance and photocurrent strength, as compared to the reference ChR can vary. For example, the recombinant or synthetic light-sensitive protein can have at least, or at least about, 1.05, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 4, 5, 6, 7, 8, 9, 10-fold improvement in one or more of light sensitivity, ion conductance and photocurrent strength, as compared to the reference ChR. In some embodiments, the recombinant or synthetic light-sensitive protein can have 1.05, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 4, 5, 6, 7, 8, 9, 10, or a range between any two of these values, -fold improvement in one or more of light sensitivity, ion conductance and photocurrent strength, as compared to the reference ChR. The light sensitivity of the recombinant or synthetic light-sensitive protein can be, for example, 1.05, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 4, 5, 6, 7, 8, 9, 10, or a range between any two of these values, times higher compared to the reference ChR. In some embodiments, the photocurrent strength of the recombinant or synthetic light-sensitive protein is, or is about, 1.05, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 4, 5, 6, 7, 8, 9, 10, or a range between any two of these values, times higher compared to the reference ChR. In some embodiments, the ion conductance of the recombinant or synthetic light-sensitive protein is, or is about, 1.05, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 4, 5, 6, 7, 8, 9, 10, or a range between any two of these values, times higher compared to the reference ChR. The measurement of light sensitivity, ion conductance, and photocurrent strength of the light-sensitive protein can be performed by techniques known in the art, for example patch-clamp electrophysiology. In some embodiments, the light-sensitive protein disclosed herein is a blue-shifted ChR. In some embodiments, the light-sensitive protein disclosed herein is a red-shifted ChR.

Functional properties of various non-limiting examples of ChR proteins are provided in Table 1. Amino acid sequences of each of the ChR described in Table 1 are provided in the Sequence Listing submitted herewith. The parent ChRs used in the Examples described herein for designing and generating the engineered ChRs are italicized, and the three engineered ChRs with top light sensitivity are bold in Table 1.

TABLE 1

Functional properties of non-limiting examples of ChR proteins

| ChR name | cyan_peak (nA) | green_peak (nA) | red_peak (nA) | cyan_ss (nA) | green_ss (nA) | red_ss (nA) | Kinetics_off | block_ID | m | green_norm | max_peak (nA) | max_ss (nA) | SEQ ID NO. |
|---|---|---|---|---|---|---|---|---|---|---|---|---|---|
| *C1C2* | *0.66* | *0.16* | *0.01* | *0.45* | *0.14* | *0* | *28* | *c1111111111* | *0* | *0.24* | *0.66* | *0.45* | *1* |
| c1 | 0.14 | 0.01 | 0.01 | 0.08 | 0 | 0 | 7 | c1000000000 | 32 | 0.08 | 0.14 | 0.08 | 2 |
| *CsChrim* | *0.83* | *0.98* | *0.77* | *0.69* | *0.77* | *0.42* | *51* | *c2222222222* | *0* | *1* | *0.98* | *0.77* | *3* |
| *CheRiff* | *0.66* | *0.06* | *0.01* | *0.46* | *0.05* | *0* | *16* | *c0000000000* | *0* | *0.1* | *0.66* | *0.46* | *4* |
| c62 | 0.01 | 0.01 | 0.01 | 0 | 0 | 0 | | c2222222022 | 10 | | 0.01 | 0 | 5 |
| c64 | 0.48 | 0.7 | 0.41 | 0.42 | 0.6 | 0.27 | 61 | c2222222220 | 17 | 1 | 0.7 | 0.6 | 6 |
| c66 | 0.07 | 0.08 | 0.04 | 0.06 | 0.07 | 0.03 | 1528 | c2212222222 | 25 | 1 | 0.08 | 0.07 | 7 |
| c67 | 0.04 | 0.04 | 0.02 | 0.03 | 0.02 | 0.01 | 88 | c2221222222 | 10 | 0.8 | 0.04 | 0.03 | 8 |
| c7 | 1.26 | 0.44 | 0.02 | 1.01 | 0.42 | 0.01 | 822 | c1111101111 | 21 | 0.35 | 1.26 | 1.01 | 9 |
| c70 | 0.45 | 0.59 | 0.53 | 0.41 | 0.51 | 0.31 | 30 | c2222221222 | 10 | 1 | 0.59 | 0.51 | 10 |
| c71 | 0.05 | 0.18 | 0.05 | 0.04 | 0.14 | 0.03 | 8 | c2222222122 | 8 | 1 | 0.18 | 0.14 | 11 |
| c73 | 0.46 | 0.75 | 0.36 | 0.42 | 0.66 | 0.31 | 82 | c2222222221 | 7 | 1 | 0.75 | 0.66 | 12 |
| c96 | 0.09 | 0.13 | 0.01 | 0.02 | 0.1 | 0 | | c2102121200 | 77 | 1 | 0.13 | 0.1 | 13 |
| n1 | 0.16 | 0.01 | 0.01 | 0.12 | 0 | 0 | 20 | n0000001000 | 40 | 0.07 | 0.16 | 0.12 | 14 |
| n10 | 1.79 | 0.82 | 0.01 | 1.23 | 0.81 | 0 | 152 | n1111111101 | 11 | 0.46 | 1.79 | 1.23 | 15 |
| n11 | 1.23 | 0.26 | 0.01 | 0.75 | 0.25 | 0 | 80 | n1111111110 | 8 | 0.21 | 1.23 | 0.75 | 16 |
| c11 | 0.34 | 0.09 | 0.01 | 0.25 | 0.08 | 0 | 23 | c1111111110 | 20 | 0.25 | 0.34 | 0.25 | 17 |
| c61 | 0.34 | 0.56 | 0.33 | 0.31 | 0.48 | 0.3 | 184 | c2222220222 | 17 | 1 | 0.56 | 0.48 | 18 |
| c12 | 0.41 | 0.12 | 0.01 | 0.29 | 0.11 | 0 | 27 | c1211111111 | 7 | 0.29 | 0.41 | 0.29 | 19 |
| c6 | 0.38 | 0.06 | 0.01 | 0.28 | 0.05 | 0 | 20 | c1111011111 | 5 | 0.16 | 0.38 | 0.28 | 20 |
| n83 | 0.13 | 0.04 | 0.01 | 0.12 | 0.03 | 0 | 5719 | n1100212201 | 84 | 0.31 | 0.13 | 0.12 | 21 |
| c39 | 1.65 | 0.19 | 0.01 | 1.05 | 0.17 | 0 | 43 | c0000100000 | 5 | 0.11 | 1.65 | 1.05 | 22 |
| c48 | 0.2 | 0.02 | 0.01 | 0.17 | 0.01 | 0 | 15 | c0002000000 | 10 | 0.09 | 0.2 | 0.17 | 23 |
| c37 | 0.4 | 0.09 | 0.01 | 0.26 | 0.08 | 0 | 21 | c0010000000 | 23 | 0.24 | 0.4 | 0.26 | 24 |
| c49 | 0.2 | 0.03 | 0.01 | 0.09 | 0.02 | 0 | 112 | c0000200000 | 10 | 0.15 | 0.2 | 0.09 | 25 |
| c3 | 0.07 | 0.02 | 0.01 | 0.06 | 0.02 | 0 | 42 | c1011111111 | 10 | 0.35 | 0.07 | 0.06 | 26 |
| c5 | 0.12 | 0.02 | 0.01 | 0.06 | 0.02 | 0 | 14 | c1110111111 | 9 | 0.19 | 0.12 | 0.06 | 27 |
| n13 | 0.01 | 0.01 | 0.01 | 0 | 0 | 0 | | n1211111111 | 33 | | 0.01 | 0 | 28 |
| c28 | 0.02 | 0.01 | 0.02 | 0 | 0 | 0 | | c1222121000 | 85 | | 0.02 | 0 | 29 |
| c21 | 0.23 | 0.11 | 0.05 | 0.19 | 0.1 | 0.03 | 337 | c1112221221 | 70 | 0.5 | 0.23 | 0.19 | 30 |
| c20 | 0.76 | 0.16 | 0.01 | 0.49 | 0.15 | 0 | 29 | c1111111112 | 7 | 0.21 | 0.76 | 0.49 | 31 |
| c2 | 0.23 | 0.46 | 0.13 | 0.19 | 0.35 | 0.07 | 23 | c1222222222 | 26 | 1 | 0.46 | 0.35 | 32 |
| c52 | 1.13 | 0.3 | 0.01 | 0.86 | 0.28 | 0 | 135 | c0000000200 | 10 | 0.27 | 1.13 | 0.86 | 33 |
| c56 | 0.49 | 0.51 | 0.43 | 0.43 | 0.47 | 0.32 | 63 | c2022222222 | 10 | 1 | 0.51 | 0.47 | 34 |
| c16 | 0.05 | 0.03 | 0.03 | 0.03 | 0.01 | 0.01 | 504 | c1111121111 | 28 | 0.56 | 0.05 | 0.03 | 35 |
| c58 | 0.07 | 0.06 | 0.02 | 0.06 | 0.05 | 0.01 | 88 | c2220222222 | 10 | 0.88 | 0.07 | 0.06 | 36 |
| c50 | 0.24 | 0.15 | 0.01 | 0.22 | 0.14 | 0 | 97 | c0000020000 | 25 | 0.64 | 0.24 | 0.22 | 37 |
| c42 | 0.68 | 0.02 | 0.01 | 0.45 | 0.01 | 0 | 13 | c0000000100 | 6 | 0.03 | 0.68 | 0.45 | 38 |
| n14 | 0.02 | 0.02 | 0.02 | 0.01 | 0.01 | 0 | | n1121111111 | 18 | 0.73 | 0.02 | 0.01 | 39 |
| n17 | 0.02 | 0.01 | 0 | 0 | 0 | 0 | | n1111121111 | 11 | | 0.02 | 0 | 40 |
| n52 | 0.03 | 0.01 | 0.01 | 0.02 | 0.01 | 0 | 772 | n0000000200 | 11 | 0.46 | 0.03 | 0.02 | 41 |
| n57 | 0.04 | 0.02 | 0.01 | 0.03 | 0.01 | 0.01 | 3038 | n2202222222 | 15 | 0.63 | 0.04 | 0.03 | 42 |
| n58 | 0.1 | 0.09 | 0.06 | 0.08 | 0.08 | 0.04 | 58 | n2220222222 | 4 | 0.98 | 0.1 | 0.08 | 43 |
| n59 | 0.24 | 0.4 | 0.24 | 0.21 | 0.33 | 0.14 | 21 | n2222022222 | 24 | 1 | 0.4 | 0.33 | 44 |
| n6 | 0.27 | 0.04 | 0.01 | 0.15 | 0.03 | 0 | 15 | n1110111111 | 3 | 0.14 | 0.27 | 0.15 | 45 |

TABLE 1-continued

Functional properties of non-limiting examples of ChR proteins

| ChR name | cyan_peak (nA) | green_peak (nA) | red_peak (nA) | cyan_ss (nA) | green_ss (nA) | red_ss (nA) | Kinetics_off | block_ID | m | green_norm | max_peak (nA) | max_ss (nA) | SEQ ID NO. |
|---|---|---|---|---|---|---|---|---|---|---|---|---|---|
| n60 | 0.17 | 0.29 | 0.17 | 0.15 | 0.27 | 0.15 | 51 | n2222202222 | 14 | 1 | 0.29 | 0.27 | 46 |
| n63 | 0.2 | 0.15 | 0.06 | 0.18 | 0.14 | 0.05 | 316 | n2222222202 | 9 | 0.73 | 0.2 | 0.18 | 47 |
| n64 | 0.11 | 0.25 | 0.07 | 0.1 | 0.19 | 0.03 | 37 | n2222222220 | 10 | 1 | 0.25 | 0.19 | 48 |
| n65 | 0.28 | 0.55 | 0.32 | 0.26 | 0.47 | 0.22 | 43 | n1222222222 | 6 | 1 | 0.55 | 0.47 | 49 |
| n68 | 0.26 | 0.23 | 0.18 | 0.21 | 0.19 | 0.08 | 20 | n2221222222 | 2 | 0.92 | 0.26 | 0.21 | 50 |
| n69 | 0.2 | 0.27 | 0.21 | 0.17 | 0.22 | 0.13 | 28 | n2222122222 | 10 | 1 | 0.27 | 0.22 | 51 |
| n7 | 0.09 | 0.02 | 0.01 | 0.07 | 0.01 | 0 | 8 | n1111011111 | 25 | 0.19 | 0.09 | 0.07 | 52 |
| n70 | 0.2 | 0.31 | 0.24 | 0.18 | 0.27 | 0.14 | 32 | n2222212222 | 11 | 1 | 0.31 | 0.27 | 53 |
| n72 | 0.04 | 0.03 | 0.01 | 0.03 | 0.01 | 0 | 286 | n2222222212 | 16 | 0.64 | 0.04 | 0.03 | 54 |
| n73 | 0.12 | 0.21 | 0.09 | 0.11 | 0.2 | 0.04 | 49 | n2222222221 | 6 | 1 | 0.21 | 0.2 | 55 |
| n51 | 0.65 | 0.04 | 0.01 | 0.53 | 0.03 | 0 | 17 | n0000002000 | 32 | 0.06 | 0.65 | 0.53 | 56 |
| n15 | 0.33 | 0.06 | 0.01 | 0.22 | 0.05 | 0 | 33 | n1112111111 | 2 | 0.19 | 0.33 | 0.22 | 57 |
| n5 | 0.14 | 0.02 | 0.01 | 0.08 | 0.01 | 0 | 32 | n1101111111 | 19 | 0.14 | 0.14 | 0.08 | 58 |
| n48 | 1.19 | 0.17 | 0.01 | 0.96 | 0.16 | 0 | 74 | n0002000000 | 4 | 0.14 | 1.19 | 0.96 | 59 |
| n18 | 0.14 | 0.04 | 0.01 | 0.13 | 0.03 | 0 | 5125 | n1111111211 | 10 | 0.28 | 0.14 | 0.13 | 60 |
| n19 | 0.16 | 0.07 | 0.02 | 0.1 | 0.05 | 0.01 | 57 | n1111111121 | 16 | 0.42 | 0.16 | 0.1 | 61 |
| n2 | 0.06 | 0.06 | 0.02 | 0.05 | 0.04 | 0.01 | 46 | n2222221222 | 33 | 0.97 | 0.06 | 0.05 | 62 |
| n20 | 0.67 | 0.37 | 0.01 | 0.6 | 0.35 | 0 | 1135 | n1111111112 | 6 | 0.55 | 0.67 | 0.6 | 63 |
| n21 | 0.05 | 0.04 | 0.02 | 0.04 | 0.02 | 0 | 576 | n2212111212 | 57 | 0.73 | 0.05 | 0.04 | 64 |
| n24 | 0.01 | 0.01 | 0.01 | 0 | 0 | 0 |  | n2112001222 | 82 |  | 0.01 | 0 | 65 |
| n25 | 0.18 | 0.09 | 0.01 | 0.17 | 0.08 | 0 | 1413 | n1022011211 | 74 | 0.49 | 0.18 | 0.17 | 66 |
| n38 | 0.26 | 0.05 | 0.01 | 0.17 | 0.04 | 0 | 12 | n0010000000 | 19 | 0.18 | 0.26 | 0.17 | 67 |
| n36 | 0.47 | 0.03 | 0.01 | 0.38 | 0.01 | 0 | 9 | n1000000000 | 5 | 0.05 | 0.47 | 0.38 | 68 |
| n4 | 0.96 | 0.41 | 0.01 | 0.72 | 0.38 | 0 | 53 | n1011111111 | 19 | 0.43 | 0.96 | 0.72 | 69 |
| n40 | 1.18 | 0.16 | 0.01 | 0.73 | 0.14 | 0 | 73 | n0000100000 | 25 | 0.13 | 1.18 | 0.73 | 70 |
| n41 | 1.01 | 0.25 | 0.01 | 0.89 | 0.24 | 0 | 182 | n0000010000 | 17 | 0.24 | 1.01 | 0.89 | 71 |
| n42 | 0.61 | 0.05 | 0.01 | 0.2 | 0.04 | 0 | 31 | n0000000100 | 4 | 0.08 | 0.61 | 0.2 | 72 |
| n43 | 0.09 | 0.01 | 0.01 | 0.05 | 0 | 0 | 13 | n0000000010 | 11 | 0.15 | 0.09 | 0.05 | 73 |
| n45 | 0.8 | 0.05 | 0.01 | 0.5 | 0.04 | 0 | 16 | n2000000000 | 7 | 0.07 | 0.8 | 0.5 | 74 |
| n39 | 1.03 | 0.37 | 0.01 | 0.93 | 0.35 | 0 | 71 | n0001000000 | 3 | 0.36 | 1.03 | 0.93 | 75 |
| c41 | 1.5 | 0.23 | 0.01 | 1.14 | 0.22 | 0 | 171 | c0000001000 | 17 | 0.15 | 1.5 | 1.14 | 76 |
| n4_2 | 0.02 | 0.01 | 0.01 | 0.01 | 0 | 0 |  | n0211111212 | 54 | 0.76 | 0.02 | 0.01 | 77 |
| c4_2 | 0.26 | 0.33 | 0.31 | 0.24 | 0.3 | 0.2 | 26 | c2222221221 | 17 | 1 | 0.33 | 0.3 | 78 |
| n5_2 | 0.03 | 0.02 | 0.01 | 0.02 | 0.01 | 0 | 520 | n2211112212 | 57 | 0.69 | 0.03 | 0.02 | 79 |
| n8_2 | 0.24 | 0.7 | 0.22 | 0.21 | 0.48 | 0.16 | 18 | n1222122222 | 16 | 1 | 0.7 | 0.48 | 80 |
| c1_2 | 0.22 | 0.32 | 0.18 | 0.21 | 0.3 | 0.1 | 42 | c2222212220 | 27 | 1 | 0.32 | 0.3 | 81 |
| c3_4 | 0.02 | 0.02 | 0.02 | 0 | 0.01 | 0 |  | c1022120120 | 84 | 1 | 0.02 | 0.01 | 82 |
| n7_4 | 0.01 | 0.01 | 0.01 | 0 | 0 | 0 |  | n0221012201 | 59 |  | 0.01 | 0 | 83 |
| c2_4 | 0.02 | 0.02 | 0.02 | 0.01 | 0.01 | 0.01 | 1186 | c2121021100 | 78 | 0.91 | 0.02 | 0.01 | 84 |
| c18_4 | 0.01 | 0.01 | 0.01 | 0 | 0 | 0 |  | c2202121120 | 62 |  | 0.01 | 0 | 85 |
| c15_4 | 0.12 | 0.05 | 0.01 | 0.09 | 0.04 | 0 | 103 | c2012000200 | 68 | 0.43 | 0.12 | 0.09 | 86 |
| c14_4 | 0.33 | 0.23 | 0.02 | 0.23 | 0.21 | 0.01 | 268 | c1012021002 | 74 | 0.69 | 0.33 | 0.23 | 87 |
| c11_4 | 0.02 | 0.02 | 0.01 | 0.01 | 0.01 | 0 |  | c2011221220 | 72 |  | 0.02 | 0.01 | 88 |
| n20_4 | 0.02 | 0.01 | 0.01 | 0.01 | 0.01 | 0 | 1270 | n2201022212 | 57 | 0.8 | 0.02 | 0.01 | 89 |
| n19_4 | 0.32 | 0.23 | 0.02 | 0.29 | 0.22 | 0.01 | 886 | n1010012220 | 93 | 0.71 | 0.32 | 0.29 | 90 |
| n12_4 | 0.01 | 0.01 | 0.01 | 0.01 | 0 | 0 |  | n0210102212 | 69 |  | 0.01 | 0.01 | 91 |
| ChR_9_4 [ChRger1] | 2.42 | 2.12 | 0.05 | 1.93 | 1.9 | 0.04 | 356 | c1210001101 | 50 | 0.87 | 2.42 | 1.93 | 92 |
| c8_4 | 0.17 | 0.19 | 0.04 | 0.08 | 0.16 | 0.03 |  | c2020121201 | 59 | 1 | 0.19 | 0.16 | 93 |
| n34_5 | 0.05 | 0.03 | 0.01 | 0.04 | 0.02 | 0 | 420 | n1000020220 | 39 | 0.7 | 0.05 | 0.04 | 94 |
| n28_5 | 0.01 | 0.01 | 0.01 | 0 | 0 | 0 |  | n1220212201 | 36 |  | 0.01 | 0 | 95 |
| c38_5 | 0.02 | 0.01 | 0.01 | 0 | 0 | 0 |  | c2122220022 | 34 |  | 0.02 | 0 | 96 |
| c31_5 | 0.02 | 0.01 | 0.01 | 0 | 0 | 0 |  | c2020222121 | 35 |  | 0.02 | 0 | 97 |
| c21_5 | 0.01 | 0.01 | 0.01 | 0 | 0 | 0 |  | c0201200100 | 35 |  | 0.01 | 0 | 98 |
| n4_7 | 0.13 | 0.1 | 0.02 | 0.12 | 0.08 | 0.01 | 2400 | n1211122202 | 45 | 0.76 | 0.13 | 0.12 | 99 |
| c2_7 | 0.01 | 0.02 | 0.01 | 0 | 0.01 | 0 | 14 | c2222220120 | 42 | 1 | 0.02 | 0.01 | 100 |
| n1_7 | 0.1 | 0.07 | 0.03 | 0.09 | 0.06 | 0.02 | 3788 | n1211022202 | 50 | 0.74 | 0.1 | 0.09 | 101 |
| c3_7 | 0.47 | 0.69 | 0.56 | 0.42 | 0.6 | 0.35 | 25 | c1122222222 | 33 | 1 | 0.69 | 0.6 | 102 |
| ChR_19_9 | 0.29 | 0.06 | 0.01 | 0.23 | 0.05 | 0 | 230 | c1202001100 | 75 | 0.22 | 0.29 | 0.23 | 103 |
| ChR_1_9 | 0.18 | 0.13 | 0.01 | 0.15 | 0.11 | 0 | 627 | n1012012202 | 98 | 0.71 | 0.18 | 0.15 | 104 |
| ChR_15_9 | 0.08 | 0.07 | 0.04 | 0.07 | 0.06 | 0.03 | 2386 | n1010112201 | 76 | 0.89 | 0.08 | 0.07 | 105 |
| ChR_21_9 | 0.21 | 0.12 | 0.01 | 0.19 | 0.11 | 0 | 683 | n1000012212 | 86 | 0.58 | 0.21 | 0.19 | 106 |
| ChR_23_9 | 0.09 | 0.05 | 0.01 | 0.07 | 0.04 | 0 | 1117 | n1002002221 | 69 | 0.56 | 0.09 | 0.07 | 107 |
| ChR_24_9 | 0.02 | 0.02 | 0.01 | 0.01 | 0.01 | 0 |  | n2220112200 | 44 |  | 0.02 | 0.01 | 108 |
| ChR-25-9 [ChRger2] | 2.54 | 0.23 | 0.01 | 1.75 | 0.22 | 0 | 145 | c2000001100 | 48 | 0.09 | 2.54 | 1.75 | 109 |
| ChR_26_9 | 0.04 | 0.03 | 0.02 | 0.02 | 0.01 | 0 | 452 | n1210112220 | 59 | 0.74 | 0.04 | 0.02 | 110 |
| ChR_11_9 | 0.56 | 0.17 | 0.01 | 0.42 | 0.16 | 0 | 2522 | n1000011002 | 72 | 0.31 | 0.56 | 0.42 | 111 |
| ChR_10_9 | 0.15 | 0.03 | 0.01 | 0.14 | 0.02 | 0 | 3440 | n2002012201 | 79 | 0.23 | 0.15 | 0.14 | 112 |
| ChR_17_9 | 0.1 | 0.08 | 0.02 | 0.09 | 0.06 | 0.01 | 116 | n1020002202 | 73 | 0.82 | 0.1 | 0.09 | 113 |
| ChR_5_9 | 0.18 | 0.14 | 0.04 | 0.14 | 0.12 | 0.03 | 1412 | c2112221100 | 83 | 0.74 | 0.18 | 0.14 | 114 |
| ChR_28_9 | 0.27 | 0.16 | 0.02 | 0.2 | 0.15 | 0.01 | 96 | c2012021100 | 96 | 0.6 | 0.27 | 0.2 | 115 |
| ChR_32_9 | 0.01 | 0.01 | 0.01 | 0 | 0 | 0 |  | n1202112201 | 57 |  | 0.01 | 0 | 116 |
| ChR_7_9 | 0.89 | 0.27 | 0.01 | 0.57 | 0.24 | 0 | 294 | c1012101100 | 69 | 0.31 | 0.89 | 0.57 | 117 |

TABLE 1-continued

Functional properties of non-limiting examples of ChR proteins

| ChR name | cyan_peak (nA) | green_peak (nA) | red_peak (nA) | cyan_ss (nA) | green_ss (nA) | red_ss (nA) | Kinetics_off | block_ID | m | green_norm | max_peak (nA) | max_ss (nA) | SEQ ID NO. |
|---|---|---|---|---|---|---|---|---|---|---|---|---|---|
| ChR_38_9 | 0.02 | 0.02 | 0.01 | 0 | 0 | 0 | | n1220022201 | 49 | | 0.02 | 0 | 118 |
| ChR_34_9 | 1.23 | 0.46 | 0.01 | 0.92 | 0.44 | 0 | 269 | c1112001101 | 44 | 0.37 | 1.23 | 0.92 | 119 |
| ChR_30_9 | 1.31 | 0.66 | 0.02 | 0.82 | 0.62 | 0 | 456 | c1211001100 | 61 | 0.51 | 1.31 | 0.82 | 120 |
| ChR_4_9 | 0.01 | 0.01 | 0.01 | 0 | 0 | 0 | | c2002221120 | 66 | | 0.01 | 0 | 121 |
| ChR_3_9 | 0.04 | 0.03 | 0.02 | 0.02 | 0.01 | 0 | 66 | n1021012220 | 88 | 0.78 | 0.04 | 0.02 | 122 |
| ChR_6_9 | 0.01 | 0.03 | 0.01 | 0 | 0 | 0 | | n1212012200 | 78 | 1 | 0.03 | 0 | 123 |
| ChR_29_9 | 0.01 | | | 0 | | | | n1221102221 | 38 | | 0.01 | 0 | 124 |
| ChR_12_10 | 3.32 | 1.8 | 0.03 | 2.26 | 1.61 | 0.02 | 179 | c1111001101 | 34 | 0.54 | 3.32 | 2.26 | 125 |
| ChR_13_10 | 0.77 | 0.3 | 0.01 | 0.64 | 0.25 | 0 | | n1111111002 | 21 | 0.39 | 0.77 | 0.64 | 126 |
| ChR_18_10 | 2.56 | 1.44 | 0.04 | 1.82 | 1.26 | 0.03 | 390 | c1211001101 | 41 | 0.56 | 2.56 | 1.82 | 127 |
| ChR_14_10 | 2.11 | 1.39 | 0.03 | 1.47 | 1.24 | 0.02 | 607 | n1111111100 | 19 | 0.66 | 2.11 | 1.47 | 128 |
| ChR_10_10 | 2 | 1.03 | 0.02 | 1.33 | 0.95 | 0.01 | 229 | n1011111100 | 38 | 0.52 | 2 | 1.33 | 129 |
| ChR_15_10 | 1.61 | 0.97 | 0.02 | 1.35 | 0.87 | 0.01 | 3544 | n1111111102 | 17 | 0.6 | 1.61 | 1.35 | 130 |
| ChR_7_10 | 0.31 | 0.03 | 0.01 | 0.25 | 0.02 | 0 | 6723 | n1002011002 | 76 | 0.1 | 0.31 | 0.25 | 131 |
| ChR_5_10 | 1.42 | 0.15 | 0.01 | 1 | 0.13 | 0 | 38 | n1001002000 | 40 | 0.1 | 1.42 | 1 | 132 |
| ChR_16_10 | 2.63 | 1.06 | 0.02 | 1.73 | 1 | 0.01 | 323 | n1112111100 | 21 | 0.4 | 2.63 | 1.73 | 133 |
| ChR_17_10 | 0.27 | 0.5 | 0.34 | 0.26 | 0.46 | 0.25 | 29 | c1122221222 | 43 | 1 | 0.5 | 0.46 | 134 |
| ChR_4_10 | 0.71 | 0.06 | 0.01 | 0.52 | 0.05 | 0 | 170 | n1000012000 | 54 | 0.09 | 0.71 | 0.52 | 135 |
| ChR-11-10 [ChRger3] | 3.47 | 1.64 | 0.02 | 2.19 | 1.39 | 0.01 | 311 | c1110001101 | 43 | 0.47 | 3.47 | 2.19 | 136 |
| ChR_9_10 | 2.56 | 1.28 | 0.02 | 1.92 | 1.17 | 0.01 | 940 | n1011111000 | 42 | 0.5 | 2.56 | 1.92 | 137 |
| ChR_3_10 | 0.72 | 0.03 | 0.01 | 0.49 | 0.02 | 0 | 10 | n1000002000 | 37 | 0.04 | 0.72 | 0.49 | 138 |
| ChR_1_10 | 0.46 | 0.03 | 0.01 | 0.31 | 0.02 | 0 | 13 | c1000000100 | 38 | 0.06 | 0.46 | 0.31 | 139 |
| ChR_29_10 | 0.03 | 0.02 | 0.01 | 0.01 | 0.01 | 0 | 216 | c1210021101 | 57 | 0.97 | 0.03 | 0.01 | 140 |
| ChR_20_10 | 0.21 | 0.41 | 0.27 | 0.19 | 0.38 | 0.17 | 30 | c1222221222 | 36 | 1 | 0.41 | 0.38 | 141 |
| ChR_21_10 | 0.85 | 0.03 | 0.01 | 0.56 | 0.02 | 0 | 11 | c2000000100 | 31 | 0.04 | 0.85 | 0.56 | 142 |
| ChR_22_10 | 0.4 | 0.04 | 0.01 | 0.28 | 0.02 | 0 | 14 | c2002000100 | 41 | 0.1 | 0.4 | 0.28 | 143 |
| ChR_23_10 | 0.14 | 0.24 | 0.14 | 0.12 | 0.22 | 0.09 | 56 | c2022221222 | 20 | 1 | 0.24 | 0.22 | 144 |
| ChR_24_10 | 0.19 | 0.33 | 0.17 | 0.18 | 0.31 | 0.12 | 62 | c2022222220 | 27 | 1 | 0.33 | 0.31 | 145 |
| ChR_6_10 | 0.46 | 0.03 | 0.01 | 0.35 | 0.02 | 0 | 8491 | n1001011002 | 75 | 0.06 | 0.46 | 0.35 | 146 |
| ChR_26_10 | 0.21 | 0.33 | 0.22 | 0.18 | 0.28 | 0.12 | 19 | c2122221222 | 17 | 1 | 0.33 | 0.28 | 147 |
| ChR_30_10 | 0.02 | 0.03 | 0.02 | 0 | 0 | 0 | | c1210021121 | 60 | 1 | 0.03 | 0 | 148 |
| ChR_2_10 | 2.12 | 0.33 | 0.01 | 1.48 | 0.31 | 0 | 146 | c1000001100 | 55 | 0.15 | 2.12 | 1.48 | 149 |
| ChR_8_10 | 2.4 | 1.03 | 0.02 | 1.59 | 0.94 | 0.01 | 217 | c1010001101 | 53 | 0.43 | 2.4 | 1.59 | 150 |
| ChR_27_10 | 0.41 | 0.65 | 0.41 | 0.32 | 0.47 | 0.16 | 20 | c2122222220 | 24 | 1 | 0.65 | 0.47 | 151 |
| ChR_28_10 | 0.82 | 1.22 | 0.82 | 0.69 | 0.96 | 0.42 | 28 | c2122222221 | 14 | 1 | 1.22 | 0.96 | 152 |
| ChR_19_10 | 0.23 | 0.55 | 0.29 | 0.21 | 0.42 | 0.22 | 13 | n1221122222 | 18 | 1 | 0.55 | 0.42 | 153 |
| ChR_25_10 | 0.29 | 0.43 | 0.29 | 0.26 | 0.38 | 0.17 | 33 | c2022222221 | 17 | 1 | 0.43 | 0.38 | 154 |

The light-sensitive protein disclosed herein can comprise a signal peptide sequence, for example natural ChR signal peptides (e.g., those described in Klapoetke et al., Nature Methods 11:338-346, 2014) or any signal peptide sequences known to be able to target proteins to the plasma cell membrane. Non-limiting examples of natural ChR signal peptides include MSRRPWLLALALAVALAAGSAGA (SEQ ID NO: 197) and MSRLVAASWLLALLLCGITSTT-TAS (SEQ ID NO: 198). In some embodiments, the signal peptide in the light-sensitive protein comprises an amino acid sequence having, or having about, 80%, 81%, 82%, 83%, 84%, 85%, 86%, 87%, 88%, 89%, 90%, 91%, 92%, 93%, 94%, 95%, 96%, 97%, 98%, 99%, 100%, or a range between any two of these values, sequence identity to an amino acid sequence selected from the group consisting of SEQ ID NO: 197 or SEQ ID NO: 198. In some embodiments, the signal peptide in the light-sensitive protein comprises an amino acid sequence having at least, or having at least about, 80%, 81%, 82%, 83%, 84%, 85%, 86%, 87%, 88%, 89%, 90%, 91%, 92%, 93%, 94%, 95%, 96%, 97%, 98%, 99%, 100% sequence identity to an amino acid sequence selected from the group consisting of SEQ ID NO: 197 or SEQ ID NO: 198. In some embodiments, the recombinant or synthetic light-sensitive protein is a mature protein. In some embodiments, the recombinant or synthetic light-sensitive protein does not comprise any signal peptide. The recombinant or synthetic light-sensitive protein can comprise one or more insertions (e.g., a synthetic tag at the 5'-terminal region of the protein). In some embodiments, the recombinant or synthetic light-sensitive protein does not comprise any insertions, e.g., tags.

The light-sensitive protein (e.g., ChR) can vary in length. For example, the light-sensitive protein can be, or be about, 200, 225, 250, 275, 300, 325, 350, 375, 400, 425, 450, 475, 500, 525, 550, or a range between any two of these values, amino acids in length. In some embodiments, the light-sensitive protein is at least, or at least about, 200, 225, 250, 275, 300, 325, 350, 375, 400, 425, 450, 475, 500, 525, 550 amino acids in length.

The light-sensitive protein can, for example, comprises, consists of, or consists essentially of, any one or more of the sequences shown in Table 2 which provides non-limiting examples of the ChRs disclosed herein.

TABLE 2

Sequences of non-limiting examples of ChR proteins (the sequence of a synthetic tag (SpyTag) is bold and underlined)

| SEQ ID NO. | ChR Name | Amino acid sequence |
|---|---|---|
| 1 | C1C2 | MSRRPWLLALALAVALAAGSAGAAHIVMVDAYKPTKSTGSDATVPVATQDGPDYVFHRAHERMLFQTSYTLENNGSVICIPNNGQC<br>FCLAWLKSNGTNAEKLAANILQWITFALSALCLMFYGYQTWKSTCGWEEIYVATIEMIKFIIEYFHEFDEPAVIYSSNGNKTVWLR<br>YAEWLLTCPVILIHLSNLIGLANDYNKRTMGLLVSDIGTIVWGITAALSKGYVRVIFFLMGLCYGIYIFFNAAKVYIEAYHTVPKG<br>RCRQVVIGMAWLFFVSWGMFPILFILGPEGFGVLSVYGSTVGHTIIDLMSKNCWGLLGHYLRVLIHEHILIHGDIRKTIKLNIGGT<br>EIEVETLVEDEAEAGAV |
| 3 | CsChrim | MSRLVAASWLLALLLCGITSITTASAHIVMVDAYKPTKSAPAASSIDGTAAAAVSHYAMNGFDELAKGAVVPEDHFVCGPADKCYC<br>SAWLHSRGTPGEKIGAQVCQWIAFSIAIALLIFYGFSAWKATCGWEEVYVCCVEVLFVTLEIFKEFSSPATVYLSIGNHAYCLRYF<br>EWLLSCPVILIRLSNLSGLKNDYSKRTMGLIVSCVGMIVFGMAAGLATDWLKWLLYIVSCIYGGYMYFQAAKCYVEANHSVPKGHC<br>RMVVKLMAYAYFASWGSYPILWAVGPEGLLKLSPYANSIGHSICDIIAKEFWTFLAHHLRIKIHEHILIHGDIRKTIKMEIGGEEV<br>EVEEFVEEEDEDTV |
| 4 | CheRiff | MGGAPAPDAHSAPPGNDSAAHIVMVDAYKPIKGGSEYHAPAGYQVNPPYHPVHGYEEQCSSIYIYYGALWEQETARGFQWFAVFLS<br>ALFLAFYGWHAYKASVGWEEVYVCSVELIKVILEIYFEFTSPAMLFLYGGNITPWLRYAEWLLTCPVILIHLSNITGLSEAYNKRT<br>MALLVSDLGTICMGVTAALATGWVKWLFYCIGLVYGTQTFYNAGIIYVESYYIMPAGGCKKLVLAMTAVYYSSWLMFPGLFIFGPE<br>GMHTLSVAGSTIGHTIADLLSKNIWGLLGHFLRIKIHEHIIMYGDIRRPVSSQFLGRKVDVLAFVTEEDKV |
| 92 | ChR_9_4<br>[ChRger1] | MSRRPWLLALALAVALAAGSAGAAHIVMVDAYKPTKSTGSDATVPVATQDGPDYVFHRAHERMLFQTSYTLENNGSVICIPNNGQC<br>FCLAWLKSNGTPGEKIGAQVCQWITFALSALCLMFYGYQTWKSTCGWEEIYVATIEMIKFIIEYFHEFDSPAMLFLYGGNITPWLR<br>YAEWLLTCPVILIHLSNITGLSEAYNKRTMALLVSDLGTICMGVTAALATGWVKWLFYCIGLVYGTQTFYNAGIIYVEAYHTVPKG<br>RCRQVVIGMAWLFFVSWGMFPILFILGPEGFGVLSVAGSTIGHTIADLLSKNIWGLLGHFLRIKIHEHILIHGDIRKTIKLNIGGT<br>EIEVETLVEDEAEAGAV |
| 109 | ChR_25_9<br>[ChRger2] | MSRLVAASWLLALLLCGITSITTASAHIVMVDAYKPTKSAPAASSIDGTAAAAVSHYAMNGFDELAKGAVVPEDHFVCGPADKCYC<br>SAWLHSRGALWEQETARGFQWFAVFLSALFLAFYGWHAYKASVGWEEVYVCSVELIKVILEIYFEFTSPAMLFLYGGNITPWLRYA<br>EWLLTCPVILIHLSNITGLSEAYNKRTMALLVSDLGTICMGVTAALATGWVKWLFYCIGLVYGTQTFYNAGIIYVEAYHTVPKGRC<br>RQVVIGMAWLFFVSWGMFPILFILGPEGFGVLSVAGSTIGHTIADLLSKNIWGLLGHFLRIKIHEHIIMYGDIRRPVSSQFLGRKV<br>DVLAFVTEEDKV |
| 125 | ChR_12_10 | MSRRPWLLALALAVALAAGSAGAAHIVMVDAYKPTKSTGSDATVPVATQDGPDYVFHRAHERMLFQTSYTLENNGSVICIPNNGQC<br>FCLAWLKSNGTNAEKLAANILQWITFALSALCLMFYGYQTWKSTCGWEEIYVATIEMIKFIIEYFHEFDEPAVIYSSNGNKTVWLR<br>YAEWLLTCPVILIHLSNITGLSEAYNKRTMALLVSDLGTICMGVTAALATGWVKWLFYCIGLVYGTQTFYNAGIIYVEAYHTVPKG<br>RCRQVVIGMAWLFFVSWGMFPILFILGPEGFGVLSVAGSTIGHTIADLLSKNIWGLLGHFLRIKIHEHILIHGDIRKTIKLNIGGT<br>EIEVETLVEDEAEAGAV |
| 126 | ChR_13_10 | MSRRPWLLALALAVALAAGSAGAAHIVMVDAYKPTKSTGSDATVPVATQDGPDYVFHRAHERMLFQTSYTLENNGSVICIPNNGQC<br>FCLAWLKSNGTNAEKLAANILQWITFALSALCLMFYGYQTWKSTCGWEEIYVATIEMIKFIIEYFHEFDEPAVIYSSGGNKTVWLR<br>YAEWLLTCPVILIHLSNLIGLANDYNKRTMGLLVSDLGTICMGVTAALATGWVKWLFYCIGLVYGGYMYFQAAKCYVEAYHTVPKG<br>RCRQVVIGMAWLFFVSWGMFPILFILGPEGFGVLSVYGSTVGHTIIDLMSKNCWGLLGHYLRVLIHEHILIHGDIRKTIKLNIGGT<br>EIEVETLVEDEAEAGAV |
| 127 | ChR_18_10 | MSRRPWLLALALAVALAAGSAGAAHIVMVDAYKPTKSTGSDATVPVATQDGPDYVFHRAHERMLFQTSYTLENNGSVICIPNNGQC<br>FCLAWLKSNGTPGEKIGAQVCQWITFALSALCLMFYGYQTWKSTCGWEEIYVATIEMIKFIIEYFHEFDEPAVIYSSNGNKTVWLR<br>YAEWLLTCPVILIHLSNITGLSEAYNKRTMALLVSDLGTICMGVTAALATGWVKWLFYCIGLVYGTQTFYNAGIIYVEAYHTVPKG<br>RCRQVVIGMAWLFFVSWGMFPILFILGPEGFGVLSVAGSTIGHTIADLLSKNIWGLLGHFLRIKIHEHILIHGDIRKTTKLNIGGT<br>EIEVETLVEDEAEAGAV |
| 128 | ChR_14_10 | MSRRPWLLALALAVALAAGSAGAAHIVMVDAYKPTKSTGSDATVPVATQDGPDYVFHRAHERMLFQTSYTLENNGSVICIPNNGQC<br>FCLAWLKSNGTNAEKLAANILQWITFALSALCLMFYGYQTWKSTCGWEEIYVATIEMIKFIIEYFHEFDEPAVIYSSGGNKTVWLR<br>YAEWLLTCPVILIHLSNLTGLANDYNKRTMALLVSDIGTIVWGTTAALATGWVKWLFYCIGLVYGTQTFYNAGIIYVEAYHTVPKG<br>RCRQVVTGMAWLFFVSWGMFPILFILGPEGFGVLSVYGSTVGHTIIDLMSKNCWGLLGHYLRVLIHEHILIHGDIRKTTKLNIGGT<br>EIEVETLVEDEAEAGAV |
| 129 | ChR_10_10 | MSRRPWLLALALAVALAAGSAGAAHIVMVDAYKPTKSTGSDATVPVATQDGPDYVFHRAHERMLFQTSYTLENNGSVICIPNNGQC<br>FCLAWLKSNGALWEQETARGFQWFAFFLSALFLAFYGYQTWKSTCGWEEIYVATIEMIKFIIEYFHEFDEPAVIYSSGGNKTVWLR<br>YAEWLLTCPVILIHLSNLTGLANDYNKRTMALLVSDIGTIVWGTTAALATGWVKWLFYCIGLVYGTQTFYNAGIIYVEAYHTVPKG<br>RCRQVVTGMAWLFFVSWGMFPILFILGPEGFGVLSVAGSTIGHTIADLLSKNIWGLLGHYLRVLIHEHILIHGDIRKTTKLNIGGT<br>EIEVETLVEDEAEAGAV |
| 130 | ChR_15_10 | MSRRPWLLALALAVALAAGSAGAAHIVMVDAYKPTKSTGSDATVPVATQDGPDYVFHRAHERMLFQTSYTLENNGSVICIPNNGQC<br>FCLAWLKSNGTNAEKLAANILQWITFALSALCLMFYGYQTWKSTCGWEEIYVATIEMIKFIIEYFHEFDEPAVIYSSGGNKTVWLR<br>YAEWLLTCPVILIHLSNLTGLANDYNKRTMGLLVSDIGTIVWGTTAALATGWVKWLFYCIGLVYGGYMYFQAAKCYVEAYHTVPKG<br>RCRQVVTGMAWLFFVSWGMFPILFILGPEGFGVLSVYGSTVGHTIIDLMSKNCWGLLGHYLRVLIHEHILIHGDIRKTTKLNIGGT<br>EIEVETLVEDEAEAGAV |
| 132 | ChR_5_10 | MSRLVAASWLLALLLCGITSTTTASAHIVMVDAYKPTKSAPAASSTDGTAAAAVSHYAMNGFDELAKGAVVPEDHFVCGPADKCYC<br>SAWLHSRGALWEQETARGFQWFAVFLSALFLAFYGWHAYKASVGWEEVYVCSVELIKVILEIYFEFTSPATVYLSGGNHAYLRYA<br>EWLLTCPVILIHLSNITGLANDYNKRTMALLVSDLGTICMGVTAALATGWVKWLFYCIGLVYGTQTFYNAGIIYVESYYIMPAGGC<br>KKLVLAMTAVYYSSWLMFPILFILGPEGFGVLSVAGSTIGHTIADLLSKNIWGLLGHFLRIKIHEHIIMYGDIRRPVSSQFLGRKV<br>DVLAFVTEEDKV |

TABLE 2-continued

Sequences of non-limiting examples of ChR proteins (the sequence of a synthetic tag (SpyTag) is bold and underlined)

| SEQ ID NO. | ChR Name | Amino acid sequence |
|---|---|---|
| 133 | ChR_16_10 | MSRRPWLLALALAVALAAGSAGAAHIVMVDAYKPTKSTGSDATVPVATQDGPDYVFHRAHERMLFQTSYTLENNGSVICIPNNGQC FCLAWLKSNGTNAEKLAANILQWITFALSALCLMFYGYQTWKSTCGWEEIYVATIEMIKFIIEYFHEFDEPAVIYSSGGNKTVWLR YAEWLLTCPVILIHLSNLTGLKNDYSKRTMALLVSDIGTIVWGTTAALATGWVKWLFYCIGLVYGTQTFYNAGIIYVEAYHTVPKG RCRQVVTGMAWLFFVSWGMFPILFILGPEGFGVLSVYGSTVGHTIIDLMSKNCWGLLGHYLRVLIHEHILIHGDIRKTTKLNIGGT EIEVETLVEDEAEAGAV |
| 136 | ChR_11_10 [ChRger3] | MSRRPWLLALALAVALAAGSAGAAHIVMVDAYKPTKSTGSDATVPVATQDGPDYVFHRAHERMLFQTSYTLENNGSVICIPNNGQC FCLAWLKSNGTNAEKLAANILQWITFALSALCLMFYGYQTWKSTCGWEEIYVATIEMIKFIIEYFHEFDSPAMLFLYGGNITPWLR YAEWLLTCPVILIHLSNITGLSEAYNKRTMALLVSDLGTICMGVTAALATGWVKWLFYCIGLVYGTQTFYNAGIIYVEAYHTVPKG RCRQVVTGMAWLFFVSWGMFPILFILGPEGFGVLSVAGSTIGHTIADLLSKNIWGLLGHFLRIKIHEHILIHGDIRKTTKLNIGGT EIEVETLVEDEAEAGAV |
| 137 | ChR_9_10 | MSRRPWLLALALAVALAAGSAGAAHIVMVDAYKPTKSTGSDATVPVATQDGPDYVFHRAHERMLFQTSYTLENNGSVICIPNNGQC FCLAWLKSNGALWEQETARGFQWFAFFLSALFLAFYGYQTWKSTCGWEEIYVATIEMIKFIIEYFHEFDEPAVIYSSGGNKTVWLR YAEWLLTCPVILIHLSNLTGLANDYNKRTMALLVSDLGTICMGVTAALATGWVKWLFYCIGLVYGTQTFYNAGIIYVEAYHTVPKG RCRQVVTGMAWLFFVSWGMFPILFILGPEGFGVLSVAGSTIGHTIADLLSKNIWGLLGHYLRVLIHEHILIHGDIRKTTKLNIGGT EIEVETLVEDEAEAGAV |
| 138 | ChR_3_10 | MSRLVAASWLLALLLCGITSTTTASAHIVMVDAYKPTKSAPAASSTDGTAAAAVSHYAMNGFDELAKGAVVPEDHFVCGPADKCYC SAWLHSRGALWEQETARGFQWFAVFLSALFLAFYGWHAYKASVGWEEVYVCSVELIKVILEIYFEFTSPATVYLSGGNHAYWLRYA EWLLTCPVILIHLSNITGLSEAYNKRTMALLVSDLGTICMGVTAALATGWVKWLFYCIGLVYGTQTFYNAGIIYVESYYIMPAGGC KKLVLAMTAVYYSSWLMFPILFILGPEGFGVLSVAGSTIGHTIADLLSKNIWGLLGHFLRIKIHEHIIMYGDIRRPVSSQFLGRKV DVLAFVTEEDKV |
| 140 | ChR_29_10 | MSRRPWLLALALAVALAAGSAGAAHIVMVDAYKPTKSTGSDATVPVATQDGPDYVEHRAHERMLFQTSYTLENNGSVICIPNNGQC FCLAWLKSNGTPGEKIGAQVCQWITEALSALCLMFYGYQTWKSTCGWEEIYVATIEMIKFIIEYFHEFDSPAMLFLYGGNITPWLR YAEWLLTCPVILIHLSNITGLSEAYNKRTMALLVSCVGMIVEGMAAGLATDWLKWLLYIVSCIYGGYMYFQAAKCYVEAYHTVPKG RCRQVVTGMAWLFFVSWGMFPILFILGPEGFGVLSVAGSTIGHTIADLLSKNIWGLLGHFLRIKIHEHILIHGDIRKTTKLNIGGT EIEVETLVEDEAEAGAV |
| 142 | ChR_21_10 | MSRLVAASWLLALLLCGITSTTTASAHIVMVDAYKPTKSAPAASSTDGTAAAAVSHYAMNGFDELAKGAVVPEDHFVCGPADKCYC SAWLHSRGALWEQETARGFQWFAVFLSALFLAFYGWHAYKASVGWEEVYVCSVELIKVILEIYFEFTSPAMLFLYGGNITPWLRYA EWLLTCPVILIHLSNITGLSEAYNKRTMALLVSDLGTICMGVTAALATGWVKWLFYCIGLVYGTQTFYNAGIIYVESYYIMPAGGC KKLVLAMTAVYYSSWGMFPILFILGPEGFGVLSVAGSTIGHTIADLLSKNIWGLLGHFLRIKIHEHIIMYGDIRRPVSSQFLGRKV DVLAFVTEEDKV |
| 146 | ChR_6_10 | MSRRPWLLALALAVALAAGSAGAAHIVMVDAYKPTKSTGSDATVPVATQDGPDYVEHRAHERMLFQTSYTLENNGSVICIPNNGQC FCLAWLKSNGALWEQETARGFQWFAVFLSALFLAFYGWHAYKASVGWEEVYVCSVELIKVILEIYFEFTEPAVIYSSGGNKTVWLR YAEWLLTCPVILIHLSNITGLANDYNKRTMGLLVSDLGTICMGVTAALATGWVKWLFYCIGLVYGGYMYFQAAKCYVESYYIMPKG RCRQVVTGMAWLFFVSWGMFPILFILGPEGFGVLSVAGSTIGHTIADLLSKNIWGLLGHYLRVLIHEHIIMYGDIRRPVSSQFLGR KVDVLAFVTEEDKV |
| 148 | ChR_30_10 | MSRRPWLLALALAVALAAGSAGAAHIVMVDAYKPTKSTGSDATVPVATQDGPDYVEHRAHERMLFQTSYTLENNGSVICIPNNGQC FCLAWLKSNGTPGEKIGAQVCQWITEALSALCLMFYGYQTWKSTCGWEEIYVATIEMIKFIIEYFHEFDSPAMLFLYGGNITPWLR YAEWLLTCPVILIHLSNITGLSEAYNKRTMALLVSDLGTICMGVTAALATGWVKWLFYCIGLVYGTQTFYNAGIIYVEAYHTVPKG RCRQVVTGMAWLFFVSWGMFPILFILGPEGFGVLSPYANSIGHSICDIIAKEFWTFLAHHLRIKIHEHILIHGDIRKTTKLNIGGT EIEVETLVEDEAEAGAV |
| 149 | ChR_2_10 | MSRRPWLLALALAVALAAGSAGAAHIVMVDAYKPTKSTGSDATVPVATQDGPDYVEHRAHERMLFQTSYTLENNGSVICIPNNGQC FCLAWLKSNGALWEQETARGFQWFAVFLSALFLAFYGWHAYKASVGWEEVYVCSVELIKVILEIYFEFTSPAMLFLYGGNITPWLR YAEWLLTCPVILIHLSNITGLSEAYNKRTMALLVSDLGTICMGVTAALATGWVKWLFYCIGLVYGTQTFYNAGIIYVEAYHTVPKG RCRQVVTGMAWLFFVSWGMFPILFILGPEGFGVLSVAGSTIGHTIADLLSKNIWGLLGHFLRIKIHEHIIMYGDIRRPVSSQFLGR KVDVLAFVTEEDKV |
| 150 | ChR_8_10 | MSRRPWLLALALAVALAAGSAGAAHIVMVDAYKPTKSTGSDATVPVATQDGPDYVEHRAHERMLFQTSYTLENNGSVICIPNNGQC FCLAWLKSNGALWEQETARGFQWFTEALSALCLMFYGYQTWKSTCGWEEIYVATIEMIKFIIEYFHEFDSPAMLFLYGGNITPWLR YAEWLLTCPVILIHLSNITGLSEAYNKRTMALLVSDLGTICMGVTAALATGWVKWLFYCIGLVYGTQTFYNAGIIYVEAYHTVPKG RCRQVVTGMAWLFFVSWGMFPILFILGPEGFGVLSVAGSTIGHTIADLLSKNIWGLLGHFLRIKIHEHILIHGDIRKTTKLNIGGT EIEVETLVEDEAEAGAV |
| 155 | C1C2 (without SpyTag) | MSRRPWLLALALAVALAAGSAGATGSDATVPVATQDGPDYVFHRAHERMLFQTSYTLENNGSVICIPNNGQCFCLAWLKSNGTNAE KLAANILQWITFALSALCLMFYGYQTWKSTCGWEEIYVATIEMIKFIIEYFHEFDEPAVIYSSNGNKTVWLRYAEWLLTCPVILIH LSNLTGLANDYNKRTMGLLVSDIGTIVWGTTAALSKGYVRVIFFLMGLCYGIYTFFNAAKVYIEAYHTVPKGRCRQVVTGMAWLFF VSWGMFPILFILGPEGFGVLSVYGSTVGHTIIDLMSKNCWGLLGHYLRVLIHEHILIHGDIRKTTKLNIGGTEIEVETLVEDEAEA GAV |
| 156 | CsChrim (without SpyTag) | MSRLVAASWLLALLLCGITSTTTASAPAASSTDGTAAAAVSHYAMNGFDELAKGAVVPEDHFVCGPADKCYCSAWLHSRGTPGEKI GAQVCQWIAFSIAIALLTFYGFSAWKATCGWEEVYVCCVEVLFVTLEIFKEFSSPATVYLSTGNHAYCLRYFEWLLSCPVILIRLS NLSGLKNDYSKRTMGLIVSCVGMIVFGMAAGLATDWLKWLLYIVSCIYGGYMYFQAAKCYVEANHSVPKGHCRMVVKLMAYAYFAS WGSYPILWAVGPEGLLKLSPYANSIGHSICDIIAKEFWTFLAHHLRIKIHEHILIHGDIRKTTKMEIGGEEVEVEEFVEEEDEDTV |

TABLE 2-continued

Sequences of non-limiting examples of ChR proteins (the sequence of a synthetic tag (SpyTag) is bold and underlined)

| SEQ ID NO. | ChR Name | Amino acid sequence |
|---|---|---|
| 157 | ChR_9_4 [ChRger1] (without SpyTag) | MSRRPWLLALALAVALAAGSAGATGSDATVPVATQDGPDYVFHRAHERMLFQTSYTLENNGSVICIPNNGQCFCLAWLKSNGTPGE KIGAQVCQWITFALSALCLMFYGYQTWKSTCGWEEIYVATIEMIKFIIEYFHEFDSPAMLFLYGGNITPWLRYAEWLLTCPVILIH LSNITGLSEAYNKRTMALLVSDLGTICMGVTAALATGWVKWLFYCIGLVYGTQTFYNAGIIYVEAYHTVPKGRCRQVVTGMAWLFF VSWGMFPILFILGPEGFGVLSVAGSTIGHTIADLLSKNIWGLLGHFLRIKIHEHILIHGDIRKTTKLNIGGTEIEVETLVEDEAEA GAV |
| 158 | ChR_25_9 [ChRger2] (without SpyTag) | MSRLVAASWLLALLLCGITSTTTASAPAASSTDGTAAAAVSHYAMNGFDELAKGAVVPEDHFVCGPADKCYCSAWLHSRGALWEQE TARGFQWFAVFLSALFLAFYGWHAYKASVGWEEVYVCSVELIKVILEIYFEFTSPAMLFLYGGNITPWLRYAEWLLTCPVILIHLS NITGLSEAYNKRTMALLVSDLGTICMGVTAALATGWVKWLFYCIGLVYGTQTFYNAGIIYVEAYHTVPKGRCRQVVTGMAWLFFVS WGMFPILFILGPEGFGVLSVAGSTIGHTIADLLSKNIWGLLGHFLRIKIHEHIIMYGDIRRPVSSQFLGRKVDVLAFVTEEDKV |
| 159 | ChR_12_10 (without SpyTag) | MSRRPWLLALALAVALAAGSAGATGSDATVPVATQDGPDYVFHRAHERMLFQTSYTLENNGSVICIPNNGQCFCLAWLKSNGTNAE KLAANILQWITFALSALCLMFYGYQTWKSTCGWEEIYVATIEMIKFIIEYFHEFDEPAVIYSSNGNKTVWLRYAEWLLTCPVILIH LSNITGLSEAYNKRTMALLVSDLGTICMGVTAALATGWVKWLFYCIGLVYGTQTFYNAGIIYVEAYHTVPKGRCRQVVTGMAWLFF VSWGMFPILFILGPEGFGVLSVAGSTIGHTIADLLSKNIWGLLGHFLRIKIHEHILIHGDIRKTTKLNIGGTEIEVETLVEDEAEA GAV |
| 160 | ChR_13_10 (without SpyTag) | MSRRPWLLALALAVALAAGSAGATGSDATVPVATQDGPDYVFHRAHERMLFQTSYTLENNGSVICIPNNGQCFCLAWLKSNGTNAE KLAANILQWITFALSALCLMFYGYQTWKSTCGWEEIYVATIEMIKFIIEYFHEFDEPAVIYSSGGNKTVWLRYAEWLLTCPVILIH LSNLTGLANDYNKRTMGLLVSDLGTICMGVTAALATGWVKWLFYCIGLVYGGYMYFQAAKCYVEAYHTVPKGRCRQVVTGMAWLFF VSWGMFPILFILGPEGFGVLSVYGSTVGHTIIDLMSKNCWGLLGHYLRVLIHEHILIHGDIRKTTKLNIGGTEIEVETLVEDEAEA GAV |
| 161 | ChR_18_10 (without SpyTag) | MSRRPWLLALALAVALAAGSAGATGSDATVPVATQDGPDYVFHRAHERMLFQTSYTLENNGSVICIPNNGQCFCLAWLKSNGTPGE KIGAQVCQWITFALSALCLMFYGYQTWKSTCGWEEIYVATIEMIKFIIEYFHEFDEPAVIYSSNGNKTVWLRYAEWLLTCPVILIH LSNITGLSEAYNKRTMALLVSDLGTICMGVTAALATGWVKWLFYCIGLVYGTQTFYNAGIIYVEAYHTVPKGRCRQVVTGMAWLFF VSWGMFPILFILGPEGFGVLSVAGSTIGHTIADLLSKNIWGLLGHFLRIKIHEHILIHGDIRKTTKLNIGGTEIEVETLVEDEAEA GAV |
| 162 | ChR_14_10 (without SpyTag) | MSRRPWLLALALAVALAAGSAGATGSDATVPVATQDGPDYVFHRAHERMLFQTSYTLENNGSVICIPNNGQCFCLAWLKSNGTNAE KLAANILQWITFALSALCLMFYGYQTWKSTCGWEEIYVATIEMIKFIIEYFHEFDEPAVIYSSGGNKTVWLRYAEWLLTCPVILIH LSNLTGLANDYNKRTMALLVSDIGTIVWGTTAALATGWVKWLFYCIGLVYGTQTFYNAGIIYVEAYHTVPKGRCRQVVTGMAWLFF VSWGMFPILFILGPEGFGVLSVYGSTVGHTIIDLMSKNCWGLLGHYLRVLIHEHILIHGDIRKTTKLNIGGTEIEVETLVEDEAEA GAV |
| 163 | ChR_10_10 (without SpyTag) | MSRRPWLLALALAVALAAGSAGATGSDATVPVATQDGPDYVFHRAHERMLFQTSYTLENNGSVICIPNNGQCFCLAWLKSNGALWE QETARGFQWFAFFLSALFLAFYGYQTWKSTCGWEEIYVATIEMIKFIIEYFHEFDEPAVIYSSGGNKTVWLRYAEWLLTCPVILIH LSNLTGLANDYNKRTMALLVSDIGTIVWGTTAALATGWVKWLFYCIGLVYGTQTFYNAGIIYVEAYHTVPKGRCRQVVTGMAWLFF VSWGMFPILFILGPEGFGVLSVAGSTIGHTIADLLSKNIWGLLGHYLRVLIHEHILIHGDIRKTTKLNIGGTEIEVETLVEDEAEA GAV |
| 164 | ChR_15_10 (without SpyTag) | MSRRPWLLALALAVALAAGSAGATGSDATVPVATQDGPDYVFHRAHERMLFQTSYTLENNGSVICIPNNGQCFCLAWLKSNGTNAE KLAANILQWITFALSALCLMFYGYQTWKSTCGWEEIYVATIEMIKFIIEYFHEFDEPAVIYSSGGNKTVWLRYAEWLLTCPVILIH LSNLTGLANDYNKRTMGLLVSDIGTIVWGTTAALATGWVKWLFYCIGLVYGGYMYFQAAKCYVEAYHTVPKGRCRQVVTGMAWLFF VSWGMFPILFILGPEGFGVLSVYGSTVGHTIIDLMSKNCWGLLGHYLRVLIHEHILIHGDIRKTTKLNIGGTEIEVETLVEDEAEA GAV |
| 165 | ChR_5_10 (without SpyTag) | MSRLVAASWLLALLLCGITSTTTASSAPAASSTDGTAAAAVSHYAMNGFDELAKGAVVPEDHFVCGPADKCYCSAWLHSRGALWEQ ETARGFQWFAVFLSALFLAFYGWHATKASVGWEEVYVCSVELIKVILEIYFEFTSPATVYLSGGNHAYWLRYAEWLLTCPVILIHL SNITGLANDYNKRTMALLVSDLGTICMGVTAALATGWVKWLFYCIGLVYGTQTFYNAGIIYVESYYIMPAGGCKKLVLAMTAVYYS SWLMFPILFILGPEGFGVLSVAGSTIGHTIADLLSKNIWGLLGHFLRIKIHEHIIMYGDIRRPVSSQFLGRKVDVLAFVTEEDKV |
| 166 | ChR_16_10 (without SpyTag) | MSRRPWLLALALAVALAAGSAGATGSDATVPVATQDGPDYVFHRAHERMLFQTSYTLENNGSVICIPNNGQCFCLAWLKSNGTNAE KLAANILQWITFALSALCLMFYGYQTWKSTCGWEEIYVATIEMIKFIIEYFHEFDEPAVIYSSGGNKTVWLRYAEWLLTCPVILIH LSNLTGLKNDYSKRTMALLVSDIGTIVWGTTAALATGWVKWLFYCIGLVYGTQTFYNAGIIYVEAYHTVPKGRCRQVVTGMAWLFF VSWGMFPILFILGPEGFGVLSVYGSTVGHTIIDLMSKNCWGLLGHYLRVLIHEHILIHGDIRKTTKLNIGGTEIEVETLVEDEAEA GAV |
| 167 | ChR_11_10 [ChRger3+ (without SpyTag) | MSRRPWLLALALAVALAAGSAGATGSDATVPVATQDGPDYVFHRAHERMLFQTSYTLENNGSVICIPNNGQCFCLAWLKSNGTNAE KLAANILQWITFALSALCLMFYGYQTWKSTCGWEEIYVATIEMIKFIIEYFHEFDSPAMLFLYGGNITPWLRYAEWLLTCPVILIH LSNITGLSEAYNKRTMALLVSDLGTICMGVTAALATGWVKWLFYCIGLVYGTQTFYNAGIIYVEAYHTVPKGRCRQVVTGMAWLFF VSWGMFPILFILGPEGFGVLSVAGSTIGHTIADLLSKNIWGLLGHFLRIKIHEHILIHGDIRKTTKLNIGGTEIEVETLVEDEAEA GAV |
| 168 | ChR_9_10 (without SpyTag) | MSRRPWLLALALAVALAAGSAGATGSDATVPVATQDGPDYVFHRAHERMLFQTSYTLENNGSVICIPNNGQCFCLAWLKSNGALWE QETARGFQWFAFFLSALFLAFYGYQTWKSTCGWEEIYVATIEMIKFIIEYFHEFDEPAVIYSSGGNKTVWLRYAEWLLTCPVILIH LSNLTGLANDYNKRTMALLVSDLGTICMGVTAALATGWVKWLFYCIGLVYGTQTFYNAGIIYVEAYHTVPKGRCRQVVTGMAWLFF VSWGMFPILFILGPEGFGVLSVAGSTIGHTIADLLSKNIWGLLGHYLRVLIHEHILIHGDIRKTTKLNIGGTEIEVETLVEDEAEA GAV |

TABLE 2-continued

Sequences of non-limiting examples of ChR proteins (the sequence of a synthetic tag (SpyTag) is bold and underlined)

| SEQ ID NO. | ChR Name | Amino acid sequence |
|---|---|---|
| 169 | ChR_3_10 (without SpyTag) | MSRLVAASWLLALLLCGITSTTTASAPAASSTDGTAAAAVSHYAMNGFDELAKGAVVPEDHFVCGPADKCYCSAWLHSRGALWEQE TARGFQWFAVFLSALFLAFYGWHAYKASVGWEEVYVCSVELIKVILEIYFEFTSPATVYLSGGNHAYWLRYAEWLLTCPVILIHLS NITGLSEAYNKRTMALLVSDLGTICMGVTAALATGWVKWLFYCIGLVYGTQTFYNAGIIYVESYYIMPAGGCKKLVLAMTAVYYSS WLMFPILFILGPEGFGVLSVAGSTIGHTIADLLSKNIWGLLGHFLRIKIHEHIIMYGDIRRPVSSQFLGRKVDVLAFVTEEDKV |
| 170 | ChR_29_10 (without SpyTag) | MSRRPWLLALALAVALAAGSAGATGSDATVPVATQDGPDYVFHRAHERMLFQTSYTLENNGSVICIPNNGQCFCLAWLKSNGTPGE KIGAQVCQWITFALSALCLMFYGYQTWKSTCGWEEIYVATIEMIKFIIEYFHEFDSPAMLFLYGGNITPWLRYAEWLLTCPVILIH LSNITGLSEAYNKRTMALLVSCVGMIVFGMAAGLATDWLKWLLYIVSCIYGGYMYFQAAKCYVEAYHTVPKGRCRQVVTGMAWLFF VSWGMFPILFILGPEGFGVLSVAGSTIGHTIADLLSKNIWGLLGHFLRIKIHEHILIHGDIRKTTKLNIGGTEIEVETLVEDEAEA GAV |
| 171 | ChR_21_10 (without SpyTag) | MSRLVAASWLLALLLCGITSTTTASAPAASSTDGTAAAAVSHYAMNGFDELAKGAVVPEDHFVCGPADKCYCSAWLHSRGALWEQE TARGFQWFAVFLSALFLAFYGWHAYKASVGWEEVYVCSVELIKVILEIYFEFTSPAMLFLYGGNITPWLRYAEWLLTCPVILIHLS NITGLSEAYNKRTMALLVSDLGTICMGVTAALATGWVKWLFYCIGLVYGTQTFYNAGIIYVESYYIMPAGGCKKLVLAMTAVYYSS WGMFPILFILGPEGFGVLSVAGSTIGHTIADLLSKNIWGLLGHFLRIKIHEHIIMYGDIRRPVSSQFLGRKVDVLAFVTEEDKV |
| 172 | ChR_6_10 (without SpyTag) | MSRRPWLLALALAVALAAGSAGATGSDATVPVATQDGPDYVFHRAHERMLFQTSYTLENNGSVICIPNNGQCFCLAWLKSNGALWE QETARGFQWFAVFLSALFLAFYGWHAYKASVGWEEVYVCSVELIKVILEIYFEFTEPAVIYSSGGNKTVWLRYAEWLLTCPVILIH LSNITGLANDYNKRTMGLLVSDLGTICMGVTAALATGWVKWLFYCIGLVYGGYMYFQAAKCYVESYYIMPKGRCRQVVTGMAWLFF VSWGMFPILFILGPEGFGVLSVAGSTIGHTIADLLSKNIWGLLGHYLRVLIHEHIIMYGDIRRPVSSQFLGRKVDVLAFVTEEDKV |
| 173 | ChR_30_10 (without SpyTag) | MSRRPWLLALALAVALAAGSAGATGSDATVPVATQDGPDYVFHRAHERMLFQTSYTLENNGSVICIPNNGQCFCLAWLKSNGTPGE KIGAQVCQWITFALSALCLMFYGYQTWKSTCGWEEIYVATIEMIKFIIEYFHEFDSPAMLFLYGGNITPWLRYAEWLLTCPVILIH LSNITGLSEAYNKRTMALLVSDLGTICMGVTAALATGWVKWLFYCIGLVYGTQTFYNAGIIYVEAYHTVPKGRCRQVVTGMAWLFF VSWGMFPILFILGPEGFGVLSPYANSIGHSICDIIAKEFWTFLAHHLRIKIHEHILIHGDIRKTTKLNIGGTEIEVETLVEDEAEA GAV |
| 174 | ChR_2_10 (without SpyTag) | MSRRPWLLALALAVALAAGSAGATGSDATVPVATQDGPDYVFHRAHERMLFQTSYTLENNGSVICIPNNGQCFCLAWLKSNGALWE QETARGFQWFAVFLSALFLAFYGWHAYKASVGWEEVYVCSVELIKVILEIYFEFTSPAMLFLYGGNITPWLRYAEWLLTCPVILIH LSNITGLSEAYNKRTMALLVSDLGTICMGVTAALATGWVKWLFYCIGLVYGTQTFYNAGIIYVEAYHTVPKGRCRQVVTGMAWLFF VSWGMFPILFILGPEGFGVLSVAGSTIGHTIADLLSKNIWGLLGHFLRIKIHEHIIMYGDIRRPVSSQFLGRKVDVLAFVTEEDKV |
| 175 | ChR_8_10 (without SpyTag) | MSRRPWLLALALAVALAAGSAGATGSDATVPVATQDGPDYVFHRAHERMLFQTSYTLENNGSVICIPNNGQCFCLAWLKSNGALWE QETARGFQWFTFALSALCLMFYGYQTWKSTCGWEEIYVATIEMIKFIIEYFHEFDSPAMLFLYGGNITPWLRYAEWLLTCPVILIH LSNITGLSEAYNKRTMALLVSDLGTICMGVTAALATGWVKWLFYCIGLVYGTQTFYNAGIIYVEAYHTVPKGRCRQVVTGMAWLFF VSWGMFPILFILGPEGFGVLSVAGSTIGHTIADLLSKNIWGLLGHFLRIKIHEHILIHGDIRKTTKLNIGGTEIEVETLVEDEAEA GAV |
| 176 | mature C1C2 (without SpyTag) | TGSDATVPVATQDGPDYVFHRAHERMLFQTSYTLENNGSVICIPNNGQCFCLAWLKSNGTNAEKLAANILQWITFALSALCLMFYG YQTWKSTCGWEEIYVATIEMIKFIIEYFHEFDEPAVIYSSNGNKTVWLRYAEWLLTCPVILIHLSNLTGLANDYNKRTMGLLVSDI GTIVWGTTAALSKGYVRVIFFLMGLCYGIYTFFNAAKVYIEAYHTVPKGRCRQVVTGMAWLFFVSWGMFPILFILGPEGFGVLSVY GSTVGHTIIDLMSKNCWGLLGHYLRVLIHEHILIHGDIRKTTKLNIGGTEIEVETLVEDEAEAGAV |
| 177 | mature CsChrim (without SpyTag) | APAASSTDGTAAAAVSHYAMNGFDELAKGAVVPEDHFVCGPADKCYCSAWLHSRGTPGEKIGAQVCQWIAFSIAIALLTFYGFSAW KATCGWEEVYVCCVEVLFVTLEIFKEFSSPATVYLSTGNHAYCLRYFEWLLSCPVILRLSNLSGLKNDYSKRTMGLIVSCVGMIV FGMAAGLATDWLKWLLYIVSCIYGGYMYFQAAKCYVEANHSVPKGHCRMVVKLMAYAYFASWGSYPILWAVGPEGLLKLSPYANSI GHSICDIIAKEFWTFLAHHLRIKIHEHILIHGDIRKTTKMEIGGEEVEVEEFVEEEDEDTV |
| 178 | mature ChR_9_4 [ChRger1] (without SpyTag) | TGSDATVPVATQDGPDYVFHRAHERMLFQTSYTLENNGSVICIPNNGQCFCLAWLKSNGTPGEKIGAQVCQWITFALSALCLMFYG YQTWKSTCGWEEIYVATIEMIKFIIEYFHEFDSPAMLFLYGGNITPWLRYAEWLLTCPVILIHLSNITGLSEAYNKRTMALLVSDL GTICMGVTAALATGWVKWLFYCIGLVYGTQTFYNAGIIYVEAYHTVPKGRCRQVVTGMAWLFFVSWGMFPILFILGPEGFGVLSVA GSTIGHTIADLLSKNIWGLLGHFLRIKIHEHILIHGDIRKTTKLNIGGTEIEVETLVEDEAEAGAV |
| 179 | mature ChR_25_9 [ChRger2] (without SpyTag) | APAASSTDGTAAAAVSHYAMNGFDELAKGAVVPEDHFVCGPADKCYCSAWLHSRGALWEQETARGFQWFAVFLSALFLAFYGWHAY KASVGWEEVYVCSVELIKVILEIYFEFTSPAMLFLYGGNITPWLRYAEWLLTCPVILIHLSNITGLSEAYNKRTMALLVSDLGTIC MGVTAALATGWVKWLFYCIGLVYGTQTFYNAGIIYVEAYHTVPKGRCRQVVTGMAWLFFVSWGMFPILFILGPEGFGVLSVAGSTI GHTIADLLSKNIWGLLGHFLRIKIHEHIIMYGDIRRPVSSQFLGRKVDVLAFVTEEDKV |
| 180 | mature ChR_12_10 (without SpyTag) | TGSDATVPVATQDGPDYVFHRAHERMLFQTSYTLENNGSVICIPNNGQCFCLAWLKSNGTNAEKLAANILQWITFALSALCLMFYG YQTWKSTCGWEEIYVATIEMIKFIIEYFHEFDEPAVIYSSNGNKTVWLRYAEWLLTCPVILIHLSNITGLSEAYNKRTMALLVSDL GTICMGVTAALATGWVKWLFYCIGLVYGTQTFYNAGIIYVEAYHTVPKGRCRQVVTGMAWLFFVSWGMFPILFILGPEGFGVLSVA GSTIGHTIADLLSKNIWGLLGHFLRIKIHEHILIHGDIRKTTKLNIGGTEIEVETLVEDEAEAGAV |
| 181 | mature ChR_13_10 (without SpyTag) | TGSDATVPVATQDGPDYVFHRAHERMLFQTSYTLENNGSVICIPNNGQCFCLAWLKSNGTNAEKLAANILQWITFALSALCLMFYG YQTWKSTCGWEEIYVATIEMIKFIIEYFHEFDEPAVIYSSGGNKTVWLRYAEWLLTCPVILIHLSNLTGLANDYNKRTMGLLVSDL GTICMGVTAALATGWVKWLFYCIGLVYGGYMYFQAAKCYVEAYHTVPKGRCRQVVTGMAWLFFVSWGMFPILFILGPEGFGVLSVY GSTVGHTIIDLMSKNCWGLLGHYLRVLIHEHILIHGDIRKTTKLNIGGTEIEVETLVEDEAEAGAV |

TABLE 2-continued

Sequences of non-limiting examples of ChR proteins (the sequence of a synthetic tag (SpyTag) is bold and underlined)

| SEQ ID NO. | ChR Name | Amino acid sequence |
|---|---|---|
| 182 | mature ChR_18_10 (without SpyTag) | TGSDATVPVATQDGPDYVFHRAHERMLFQTSYTLENNGSVICIPNNGQCFCLAWLKSNGTPGEKIGAQVCQWITFALSALCLMFYG YQTWKSTCGWEEIYVATIEMIKFIIEYFHEFDEPAVIYSSNGNKTVWLRYAEWLLTCPVILIHLSNITGLSEAYNKRTMALLVSDL GTICMGVTAALATGWVKWLFYCIGLVYGTQTFYNAGIIYVEAYHTVPKGRCRQVVTGMAWLFFVSWGMFPILFILGPEGFGVLSVA GSTIGHTIADLLSKNIWGLLGHFLRIKIHEHILIHGDIRKTTKLNIGGTEIEVETLVEDEAEAGAV |
| 183 | mature ChR_14_10 (without SpyTag) | TGSDATVPVATQDGPDYVFHRAHERMLFQTSYTLENNGSVICIPNNGQCFCLAWLKSNGTNAEKLAANILQWITFALSALCLMFYG YQTWKSTCGWEEIYVATIEMIKFIIEYFHEFDEPAVIYSSGGNKTVWLRYAEWLLTCPVILIHLSNLTGLANDYNKRTMALLVSDI GTIVWGTTAALATGWVKWLFYCIGLVYGTQTFYNAGIIYVEAYHTVPKGRCRQVVTGMAWLFFVSWGMFPILFILGPEGFGVLSVY GSTVGHTIIDLMSKNCWGLLGHYLRVLIHEHILIHGDIRKTTKLNIGGTEIEVETLVEDEAEAGAV |
| 184 | mature ChR_10_10 (without SpyTag) | TGSDATVPVATQDGPDYVFHRAHERMLFQTSYTLENNGSVICIPNNGQCFCLAWLKSNGALWEQETARGFQWFAFFLSALFLAFYG YQTWKSTCGWEEIYVATIEMIKFIIEYFHEFDEPAVIYSSGGNKTVWLRYAEWLLTCPVILIHLSNLTGLANDYNKRTMALLVSDI GTIVWGTTAALATGWVKWLFYCIGLVYGTQTFYNAGIIYVEAYHTVPKGRCRQVVTGMAWLFFVSWGMFPILFILGPEGFGVLSVA GSTIGHTIADLLSKNIWGLLGHYLRVLIHEHILIHGDIRKTTKLNIGGTEIEVETLVEDEAEAGAV |
| 185 | mature ChR_15_10 (without SpyTag) | TGSDATVPVATQDGPDYVFHRAHERMLFQTSYTLENNGSVICIPNNGQCFCLAWLKSNGTNAEKLAANILQWITFALSALCLMFYG YQTWKSTCGWEEIYVATIEMIKFIIEYFHEFDEPAVIYSSGGNKTVWLRYAEWLLTCPVILIHLSNLTGLANDYNKRTMGLLVSDI GTIVWGTTAALATGWVKWLFYCIGLVYGGYMYFQAAKCYVEAYHTVPKGRCRQVVTGMAWLFFVSWGMFPILFILGPEGFGVLSVY GSTVGHTIIDLMSKNCWGLLGHYLRVLIHEHILIHGDIRKTTKLNIGGTEIEVETLVEDEAEAGAV |
| 186 | mature ChR_5_10 (without SpyTag) | APAASSTDGTAAAAVSHYAMNGFDELAKGAVVPEDHFVCGPADKCYCSAWLHSRGALWEQETARGFQWFAVFLSALFLAFYGWHAY KASVGWEEVYVCSVELIKVILEIYFEFTSPATVYLSGGNHAYWLRYAEWLLTCPVILIHLSNITGLANDYNKRTMALLVSDLGTIC MGVTAALATGWVKWLFYCIGLVYGTQTFYNAGIIYVESYYIMPAGGCKKLVLAMTAVYYSSWLMFPILFILGPEGFGVLSVAGSTI GHTIADLLSKNIWGLLGHFLRIKIHEHIIMYGDIRRPVSSQFLGRKVDVLAFVTEEDKV |
| 187 | mature ChR_16_10 (without SpyTag) | TGSDATVPVATQDGPDYVFHRAHERMLFQTSYTLENNGSVICIPNNGQCFCLAWLKSNGTNAEKLAANILQWITFALSALCLMFYG YQTWKSTCGWEEIYVATIEMIKFIIEYFHEFDEPAVIYSSGGNKTVWLRYAEWLLTCPVILIHLSNLTGLKNDYSKRTMALLVSDI GTIVWGTTAALATGWVKWLFYCIGLVYGTQTFYNAGIIYVEAYHTVPKGRCRQVVTGMAWLFFVSWGMFPILFILGPEGFGVLSVY GSTVGHTIIDLMSKNCWGLLGHYLRVLIHEHILIHGDIRKTTKLNIGGTEIEVETLVEDEAEAGAV |
| 188 | mature ChR_11_10 [ChRger3] (without SpyTag) | TGSDATVPVATQDGPDYVFHRAHERMLFQTSYTLENNGSVICIPNNGQCFCLAWLKSNGTNAEKLAANILQWITFALSALCLMFYG YQTWKSTCGWEEIYVATIEMIKFIIEYFHEFDSPAMLFLYGGNITPWLRYAEWLLTCPVILIHLSNITGLSEAYNKRTMALLVSDL GTICMGVTAALATGWVKWLFYCIGLVYGTQTFYNAGIIYVEAYHTVPKGRCRQVVTGMAWLFFVSWGMFPILFILGPEGFGVLSVA GSTIGHTIADLLSKNIWGLLGHFLRIKIHEHILIHGDIRKTTKLNIGGTEIEVETLVEDEAEAGAV |
| 189 | mature ChR_9_10 (without SpyTag) | TGSDATVPVATQDGPDYVFHRAHERMLFQTSYTLENNGSVICIPNNGQCFCLAWLKSNGALWEQETARGFQWFAFFLSALFLAFYG YQTWKSTCGWEEIYVATIEMIKFIIEYFHEFDEPAVIYSSGGNKTVWLRYAEWLLTCPVILIHLSNLTGLANDYNKRTMALLVSDL GTICMGVTAALATGWVKWLFYCIGLVYGTQTFYNAGIIYVEAYHTVPKGRCRQVVTGMAWLFFVSWGMFPILFILGPEGFGVLSVA GSTIGHTIADLLSKNIWGLLGHFLRIKIHEHILIHGDIRKTTKLNIGGTEIEVETLVEDEAEAGAV |
| 190 | mature ChR_3_10 (without SpyTag) | APAASSTDGTAAAAVSHYAMNGFDELAKGAVVPEDHFVCGPADKCYCSAWLHSRGALWEQETARGFQWFAVFLSALFLAFYGWHAY KASVGWEEVYVCSVELIKVILEIYFEFTSPATVYLSGGNHAYWLRYAEWLLTCPVILIHLSNITGLSEAYNKRTMALLVSDLGTIC MGVTAALATGWVKWLFYCIGLVYGTQTFYNAGIIYVESYYIMPAGGCKKLVLAMTAVYYSSWLMFPILFILGPEGFGVLSVAGSTI GHTIADLLSKNIWGLLGHFLRIKIHEHIIMYGDIRRPVSSQFLGRKVDVLAFVTEEDKV |
| 191 | mature ChR_29_10 (without SpyTag) | TGSDATVPVATQDGPDYVFHRAHERMLFQTSYTLENNGSVICIPNNGQCFCLAWLKSNGTPGEKIGAQVCQWITFALSALCLMFYG YQTWKSTCGWEEIYVATIEMIKFIIEYFHEFDSPAMLFLYGGNITPWLRYAEWLLTCPVILIHLSNITGLSEAYNKRTMALLVSCV GMIVFGMAAGLATDWLKWLLYIVSCIYGGYMYFQAAKCYVEAYHTVPKGRCRQVVTGMAWLFFVSWGMFPILFILGPEGFGVLSVA GSTIGHTIADLLSKNIWGLLGHFLRIKIHEHILIHGDIRKTTKLNIGGTEIEVETLVEDEAEAGAV |
| 192 | mature ChR_21_10 (without SpyTag) | APAASSTDGTAAAAVSHYAMNGFDELAKGAVVPEDHFVCGPADKCYCSAWLHSRGALWEQETARGFQWFAVFLSALFLAFYGWHAY KASVGWEEVYVCSVELIKVILEIYFEFTSPAMLFLYGGNITPWLRYAEWLLTCPVILIHLSNITGLSEAYNKRTMALLVSDLGTIC MGVTAALATGWVKWLFYCIGLVYGTQTFYNAGIIYVESYYIMPAGGCKKLVLAMTAVYYSSWLMFPILFILGPEGFGVLSVAGSTI GHTIADLLSKNIWGLLGHFLRIKIHEHIIMYGDIRRPVSSQFLGRKVDVLAFVTEEDKV |
| 193 | mature ChR_6_10 (without SpyTag) | TGSDATVPVATQDGPDYVFHRAHERMLFQTSYTLENNGSVICIPNNGQCFCLAWLKSNGALWEQETARGFQWFAVFLSALFLAFYG WHAYKASVGWEEVYVCSVELIKVILEIYFEFTEPAVIYSSGGNKTVWLRYAEWLLTCPVILIHLSNITGLANDYNKRTMGLLVSDL GTICMGVTAALATGWVKWLFYCIGLVYGGYMYFQAAKCYVESYYIMPKGRCRQVVTGMAWLFFVSWGMFPILFILGPEGFGVLSVA GSTIGHTIADLLSKNIWGLLGHYLRVLIHEHIIMYGDIRRPVSSQFLGRKVDVLAFVTEEDKV |
| 194 | mature ChR_30_10 (without SpyTag) | TGSDATVPVATQDGPDYVFHRAHERMLFQTSYTLENNGSVICIPNNGQCFCLAWLKSNGTPGEKIGAQVCQWITFALSALCLMFYG YQTWKSTCGWEEIYVATIEMIKFIIEYFHEFDSPAMLFLYGGNITPWLRYAEWLLTCPVILIHLSNITGLSEAYNKRTMALLVSDL GTICMGVTAALATGWVKWLFYCIGLVYGTQTFYNAGIIYVEAYHTVPKGRCRQVVTGMAWLFFVSWGMFPILFILGPEGFGVLSPY ANSIGHSICDIIAKEFWTFLAHHLRIKIHEHILIHGDIRKTTKLNIGGTEIEVETLVEDEAEAGAV |
| 195 | mature ChR_2_10 (without SpyTag) | TGSDATVPVATQDGPDYVFHRAHERMLFQTSYTLENNGSVICIPNNGQCFCLAWLKSNGALWEQETARGFQWFAVFLSALFLAFYG WHAYKASVGWEEVYVCSVELIKVILEIYFEFTSPAMLFLYGGNITPWLRYAEWLLTCPVILIHLSNITGLSEAYNKRTMALLVSDL GTICMGVTAALATGWVKWLFYCIGLVYGTQTFYNAGIIYVEAYHTVPKGRCRQVVTGMAWLFFVSWGMFPILFILGPEGFGVLSVA GSTIGHTIADLLSKNIWGLLGHFLRIKIHEHIIMYGDIRRPVSSQFLGRKVDVLAFVTEEDKV |

TABLE 2-continued

Sequences of non-limiting examples of ChR proteins (the sequence of a synthetic tag (SpyTag) is bold and underlined)

| SEQ ID NO. | ChR Name | Amino acid sequence |
|---|---|---|
| 196 | mature ChR_8_10 (without SpyTag) | TGSDATVPVATQDGPDYVFHRAHERMLFQTSYTLENNGSVICIPNNGQCFCLAWLKSNGALWEQETARGFQWFTFALSALCLMFYG YQTWKSTCGWEEIYVATIEMIKFIIEYFHEFDSPAMLFLYGGNITPWLRYAEWLLTCPVILIHLSNITGLSEAYNKRTMALLVSDL GTICMGVTAALATGWVKWLFYCIGLVYGTQTFYNAGIIYVEAYHTVPKGRCRQVVTGMAWLFFVSWGMFPILFILGPEGFGVLSVA GSTIGHTIADLLSKNIWGLLGHFLRIKIHEHILIHGDIRKTTKLNIGGTEIEVETLVEDEAEAGAV |

Also disclosed herein are nucleic acid molecules comprising the nucleotide sequences that encode one or more of the light-sensitive proteins described herein. The nucleic acid molecule can be a recombinant expression vector, for example, a viral vector. Examples of viral vector include, but are not limited to, adeno-associated viral vectors, lentiviral vectors, herpes simplex virus vectors, and retroviral vectors. In the nucleic acid molecule, the nucleotide sequence encoding the one or more light-sensitive proteins is operably linked to a transcriptional control element. It can be advantageous in some embodiments that the transcriptional control element is functional in a photoreceptor cell. The photoreceptor cell can be a rod cell, a cone cell, a retinal cell, or a combination thereof. The transcriptional control element can be, for example, promoter (e.g., a retinal cell-specific promoter). Non-limiting examples of the promoter include synapsin promoter, a CAG promoter, a cytomegalovirus promoter (CMV) promoter, a grm6 promoter, a Pleiades promoter, a ChAT promoter, a V-glut promoter, a GAD promoter, a PV promoter, a somatostatin (SST) promoter, a neuropeptide Y (NPY) promoter, a VIP promoter, a red cone opsin promoter, rhodopsin promoter, a rhodopsin kinase promoter, vitelliform macular dystrophy 2 (VMD2) gene promoter, an interphotoreceptor retinoid-binding protein (IRBP) gene promoter, elongation factor-1 alpha (EF-1 alpha) promoter, and a combination thereof.

Disclosed herein includes methods and compositions for expressing one or more of the light-sensitive proteins (e.g., ChRs) disclosed herein in cells, tissues, organs, and/or subjects, where the ChR(s) can be activated by contact with one or more pulses of light, which results in strong depolarization of the cells or the cells in the tissues, organs and/or subjects. In some embodiments, the expression of the ChR(s) is used to control cells, tissues, organs and/or subjects in vivo, ex vivo, and/or in vitro in response to pulses of light of a suitable wavelength. A cell, comprising (a) a recombinant or synthetic light-sensitive protein, (b) a nucleic acid molecule comprising a coding sequence of a light-sensitive protein, or both, is provided. The cell can be, for example, a mammalian cell or non-mammalian cell. In some embodiments, the cell is a rod cell, a cone cell, or a retina cell. The cell can be a neuronal cell, an electrically active cell, or both. In some embodiments, the cell is a recombinant host cell, for example, a mammalian cell, a bacterial cell, a yeast cell, an insect cell, a plant cell, or a combination thereof. Some embodiments provided a composition comprising one or more of (a) the cell, (b) the recombinant or synthetic light-sensitive protein, and (c) the nucleic acid molecule comprising the coding sequence of the light-sensitive protein. The composition can be, for example, a pharmaceutical composition comprising one or more pharmaceutically acceptable excipient.

Compositions for Delivering Light-Sensitive Proteins to a Subject

Various systems and methods are known in the art for delivering nucleic acid molecules into a cell, a tissue, an organ, and/or a subject. The delivery can be, for example, target-specific, tissue-specific, cell type specific, organ specific, nonspecific, and/or systematic. In some embodiments, the nucleic acid molecule comprises a coding sequence for one or more proteins, and the delivery is used for expressing the one or more proteins encoded by the nucleic acid molecule in the target cell, tissue, organ, and/or subject.

Disclosed herein include a nucleic acid molecule (e.g., an expression vector) comprising a coding sequence for the light-sensitive protein (e.g., one or more of the ChRs disclosed herein) for use in treating or ameliorating blindness, restoring or enhancing vision and photosensitivity, treating or ameliorating vision loss in a subject. In some embodiments, the method comprises delivering (e.g., injecting) the nucleic acid molecule into the LGN of the subject. The expression of the light-sensitive protein can be controlled by a transcription regulatory element, for example a promoter selected from the group of Human elongation factor-1 alpha (EF-1 alpha), Human cytomegalovirus promoter (CMV) or CAG promoter. Also disclosed include a composition, for example a pharmaceutical composition, comprising the nucleic acid molecule (e.g., a vector) comprising the coding sequence for the light-sensitive protein. The nucleic acid molecule can be any of the nucleic acid molecule encoding the light-sensitive protein and disclosed herein, Many different viral and non-viral vectors and methods of their delivery, for use in gene delivery (including gene therapy), are known, including adenovirus vectors, adeno-associated virus (AAV) vectors, retrovirus vectors, lentiviral vectors, herpes virus vectors, liposomes, poxviruses, naked DNA administration, plasmids, cosmids, phages, encapsulated cell technology, and the like. A detailed review of possible techniques for transforming genes into desired cells of the eye is taught by Wright (Br J Ophthalmol, 1997; 81: 620-622). The vectors can be used to deliver one or more of the light-sensitive proteins (e.g., ChRs) disclosed herein or the coding sequences for the one or more of the proteins to a subject in need thereof. Expression of the light-sensitive proteins disclosed herein can be controlled by, for example, a cell specific promoter to allow expression occurred only in a specific cell type (e.g., retinal cells).

Adeno-associated virus (AAV) is a replication-deficient parvovirus, the single-stranded DNA genome of which is about 4.7 kb in length including 145 nucleotides inverted terminal repeat (ITRs). The ITRs play a role in integration of the AAV DNA into the host cell genome. When AAV infects a host cell, the viral genome integrates into the host's chromosome resulting in latent infection of the cell. In a natural system, a helper virus (for example, adenovirus or herpesvirus) provides genes that allow for production of AAV virus in the infected cell. In the case of adenovirus, genes E1A, E1B, E2A, E4 and VA provide helper functions. Upon infection with a helper virus, the AAV provirus is rescued and amplified, and both AAV and adenovirus are produced. In the instances of recombinant AAV vectors having no Rep and/or Cap genes, the AAV can be non-integrating.

AAV vectors that comprise coding regions of one or more light-sensitive proteins (e.g., the ChRs disclosed herein) are provided. The AAV vector can include a 5' inverted terminal repeat (ITR) of AAV, a 3' AAV ITR, a promoter, and a restriction site downstream of the promoter to allow insertion of a polynucleotide encoding one or more light-sensitive proteins, wherein the promoter and the restriction site are located downstream of the 5' AAV ITR and upstream of the 3' AAV ITR. In some embodiments, the AAV vector includes a posttranscriptional regulatory element downstream of the restriction site and upstream of the 3' AAV ITR. In some embodiments, the AAV vectors disclosed herein can be used as AAV transfer vectors carrying a transgene encoding a light-sensitive protein for producing recombinant AAV viruses that can express the light-sensitive protein in a cell.

Generation of the viral vector can be accomplished using any suitable genetic engineering techniques well known in the art, including, without limitation, the standard techniques of restriction endonuclease digestion, ligation, transformation, plasmid purification, and DNA sequencing, for example as described in Sambrook et al. (Molecular Cloning: A Laboratory Manual. Cold Spring Harbor Laboratory Press, N.Y. (1989)). The viral vector can incorporate sequences from the genome of any known organism. The sequences can be incorporated in their native form or can be modified in any way to obtain a desired activity. For example, the sequences can comprise insertions, deletions or substitutions.

In some embodiments, the viral vectors can include additional sequences that make the vectors suitable for replication and integration in eukaryotes. In other embodiments, the viral vectors disclosed herein can include a shuttle element that makes the vectors suitable for replication and integration in both prokaryotes and eukaryotes. In some embodiments, the viral vectors can include additional transcription and translation initiation sequences, such as promoters and enhancers; and additional transcription and translation terminators, such as polyadenylation signals. Various regulatory elements that can be included in an AAV vector have been described in detail in US Patent Publication 2012/0232133 which is hereby incorporated by reference in its entirety.

Pharmaceutical Compositions and Methods of Administration

Light-sensitive proteins (e.g., ChRs) with desirable properties are provided herein. Disclosed herein include cells, tissues, organs, and subjects that comprises one or more of the light-sensitive proteins, one or more of the nucleic acid molecules (e.g., vectors) comprising coding sequence(s) for the light-sensitive protein(s). Also disclosed include pharmaceutical compositions comprising one or more of the light-sensitive proteins, one or more of the nucleic acid molecules (e.g., vectors) comprising coding sequence(s) for the light-sensitive proteins, and/or one or more of the cells comprising the light-sensitive protein(s) disclosed herein, and one or more pharmaceutically acceptable carriers. The compositions can also comprise additional ingredients such as diluents, stabilizers, excipients, and adjuvants. As used herein, "pharmaceutically acceptable" carriers, excipients, diluents, adjuvants, or stabilizers are the ones nontoxic to the cell or subject being exposed thereto (preferably inert) at the dosages and concentrations employed or that have an acceptable level of toxicity as determined by the skilled practitioners.

The carriers, diluents and adjuvants can include buffers such as phosphate, citrate, or other organic acids; antioxidants such as ascorbic acid; low molecular weight polypeptides (e.g., less than about 10 residues); proteins such as serum albumin, gelatin or immunoglobulins; hydrophilic polymers such as polyvinylpyrrolidone; amino acids such as glycine, glutamine, asparagine, arginine, or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as Tween™, Pluronics™ or polyethylene glycol (PEG). In some embodiments, the physiologically acceptable carrier is an aqueous pH buffered solution.

In some embodiments, the pharmaceutical composition comprises a non-viral vector or a viral (e.g., AAV) vector comprising a coding sequence of any one of the light-sensitive proteins described herein. Titers of the viral vector to be administered will vary depending, for example, on the particular viral vector, the mode of administration, the treatment goal, the individual, and the cell type(s) being targeted, and can be determined by methods standard in the art.

As will be readily apparent to one of skill in the art, the useful in vivo dosage of the recombinant virus to be administered and the particular mode of administration will vary depending upon the age, weight, the severity of the affliction, and animal species treated, the particular recombinant virus expressing the protein of interest that is used, and the specific use for which the recombinant virus is employed. The determination of effective dosage levels, that is the dosage levels necessary to achieve the desired result, can be accomplished by one skilled in the art using routine pharmacological methods. Typically, human clinical applications of products are commenced at lower dosage levels, with dosage level being increased until the desired effect is achieved. Alternatively, acceptable in vitro studies can be used to establish useful doses and routes of administration of the compositions identified by the present methods using established pharmacological methods.

Although the exact dosage will be determined on a drug-by-drug basis, in most cases, some generalizations regarding the dosage can be made. In some embodiments, the viral vector for delivery a nucleic acid to a subject (e.g., systematic delivery, or delivery to the eye or brain tissue of the subject) can be administered, for example via injection, to a subject at a dose of between $1 \times 10^{10}$ genome copies (GC) of the recombinant virus per kg of the subject and $2 \times 10^{14}$ GC per kg, for example between $5 \times 10^{11}$ GC/kg and $5 \times 10^{12}$ GC/kg. In some embodiments, the dose of the viral vector (e.g., AAV vectors) administered to the subject is no more than $2 \times 10^{14}$ GC per kg. In some embodiments, the dose of the viral vector administered to the subject is no more than $5 \times 10^{12}$ GC per kg. In some embodiments, the dose of the viral vector administered to the subject is no more than $5 \times 10^{11}$ GC per kg.

The nucleic acid molecule, for example, a vector (e.g., a viral vector)) comprising a nucleotide sequence encoding the light-sensitive protein can be administered to a subject (e.g., a human) in need thereof. The route of the administration is not particularly limited. For example, a therapeutically effective amount of the nucleic acid molecule can be administered to the subject by via routes standard in the art. Non-limiting examples of the route include intravitreal, intravenous, intraocular, or subretinal administration (e.g., intravitreal, intravenous, intraocular, or subretinal injection), depending on the retinal layer being targeted. In some embodiments, the nucleic acid molecule is administered to the subject by systematic transduction. In some embodiments, the nucleic acid molecule is administered to the subject by intravenous injection. In some embodiments, the nucleic acid molecule is administered to the subject by subretinal injection. In some embodiments, the administration of the nucleic acid molecule targeting of retinal pigment epithelium—the most distal layer from the vitreal space. In some embodiments, the delivery of the nucleic acid molecule is targeted to retinal ganglion cells, bipolar cells, or both. The ganglion cells are, in some embodiments, accessible to intravitreal injection as disclosed herein. Intravitreal and/or subretinal injection can be used, in some embodiments to target the bipolar cells, for example in circumstances in which the photoreceptor cell layer is absent due to degeneration.

Actual administration of the expression vectors for the light-sensitive proteins can be accomplished by using any physical method that will transport the vectors (e.g., viral vectors) into the target tissue(s) (e.g., eye tissue and brain tissue) of the subject. In some embodiments, the vectors can be administered systematically, e.g., by intravenous injection. Pharmaceutical compositions can be prepared, for example, as injectable formulations. The recombinant virus to be used can be utilized in liquid or freeze-dried form (in combination with one or more suitable preservatives and/or protective agents to protect the virus during the freeze-drying process). For gene therapy (e.g., of neuronal and ocular disorders which may be ameliorated by a specific gene product) a therapeutically effective dose of the recombinant virus expressing the therapeutic protein is administered to a host in need of such treatment. The use of the recombinant virus disclosed herein in the manufacture of a medicament for inducing immunity in, or providing gene therapy to, a host is within the scope of the present application.

In instances where human dosages for the viral vector (e.g., AAV vector) have been established for at least some condition, those same dosages, or dosages that are between about 0.1% and 500%, more preferably between about 25% and 250% of the established human dosage can be used. Where no human dosage is established, as will be the case for newly-discovered pharmaceutical compositions, a suitable human dosage can be inferred from $ED_{50}$ or $ID_{50}$ values, or other appropriate values derived from in vitro or in vivo studies, as qualified by toxicity studies and efficacy studies in animals.

A therapeutically effective amount of the expression vector (e.g., AAV vector) can be administered to a subject at various points of time. For example, the expression vector can be administered to the subject prior to, during, or after the subject has developed a disease or disorder. The expression vector can also be administered to the subject prior to, during, or after the occurrence of a disease or disorder (e.g., neuronal disorders, ocular disorders, or a combination thereof). In some embodiments, the expression vector is administered to the subject during remission of the disease or disorder. In some embodiments, the expression vector is administered prior to the onset of the disease or disorder in the subject. In some embodiments, the expression vector is administered to a subject at a risk of developing the disease or disorder.

The dosing frequency of the expression vector (e.g., viral vector) can vary. For example, the viral vector can be administered to the subject about once every week, about once every two weeks, about once every month, about one every six months, about once every year, about once every two years, about once every three years, about once every four years, about once every five years, about once every six years, about once every seven years, about once every eight years, about once every nine years, about once every ten years, or about once every fifteen years. In some embodiments, the viral vector is administered to the subject at most about once every week, at most about once every two weeks, at most about once every month, at most about one every six months, at most about once every year, at most about once every two years, at most about once every three years, at most about once every four years, at most about once every five years, at most about once every six years, at most about once every seven years, at most about once every eight years, at most about once every nine years, at most about once every ten years, or at most about once every fifteen years.

Uses of Light-Sensitive Proteins

Light-sensitive proteins, for example the engineered ChRs, disclosed herein can be used to treat or prevent neuronal disorders, ocular disorders, or both. In some embodiments, the light-sensitive proteins can be used to restore and/or improve light sensitivity and/or vision of a subject. The visual signal is initially processed in the retina and most of conscious vision is then relayed to the lateral geniculate nucleus (LGN) of the thalamus, which in turn projects to the primary visual cortex. Since the visual signal is processed less in the LGN than in the cortex, and the number of cells dedicated to the same visual angle or retinal area is smaller in the LGN than in the cortex, it is contemplated herein that, in some embodiments, the cells of the LGN can be stimulated to restore vision. For example, LGN cells can be activated optogenetically using a composition (e.g., an expression vector, including a viral vector) comprising a coding sequence for a light-sensitive protein (e.g., one or more of the ChRs disclosed herein) to illuminate with visual patters the axon terminals of LGN cells where they form connections with the visual cortex, in the more accessible surface of the brain. LGN cell stimulation can, in some embodiments, evoke meaningful responses in blind and/or normal-sighted subjects. For example, normal or blind subjects can be caused to express one or more of the engineered ChRs in the LGN cells (e.g., via an AAV vector), as well as with GCAMP in the cortex to stimulate the axon terminals of LGN cell in the cortex and evoke responses in the cortex.

A method, which comprises expressing a light-sensitive protein in a subject in need thereof is provided, where the light-sensitive protein is any one of the light-sensitive protein disclosed herein (e.g., the engineered ChRs). The light-sensitive protein can comprise an amino acid sequence having at least 80% sequence identity to SEQ ID NOs: 1-139, 141-147 and 149-196. In some embodiments, the light-sensitive protein comprising an amino acid sequence selected from the group consisting of SEQ ID NOs: 93, 109, 125-130, 132, 133, 136-138, 142, 146, 149, 150, and 155-196. In some embodiments, the light-sensitive protein comprises an amino acid sequence having at least 95% sequence identity to an amino acid sequence selected from the group consisting of SEQ ID NOs: 178-196. It is advantageous, in some embodiments, to use the light-sensitive protein with increased light sensitivity, ion conductance, photocurrent strength, or any combination thereof, in the method. For example, the light-sensitive protein can have at least two-fold improvement in one or more of light sensitivity, photocurrent strength, and ion conductance, as compared to a ChR consisting of the amino acid sequence of SEQ ID NO: 1, 3, 4, 155, 156, 176, or 177.

The methods and composition (e.g., one or more of the ChRs and the expression vectors for the ChRs) disclosed herein can be used to treat a subject suffering from an ocular disorder, whereby the expression of the light-sensitive protein in the subject treats or ameliorates the ocular disorder. Examples of ocular disorders that can be treated or ameliorated include, but are not limited to, developmental abnormalities that affect both anterior and posterior segments of the eye. Anterior segment disorders include, for example, glaucoma, cataracts, corneal dystrophy, keratoconus. Posterior segment disorders include, for example, blinding disorders caused by photoreceptor malfunction and/or death caused by retinal dystrophies and degenerations. Retinal disorders include, for example, congenital stationary night blindness, age-related macular degeneration, congenital cone dystrophies, and a large group of retinitis-pigmentosa (RP)-related disorders. These disorders include genetically pre-disposed death of photoreceptor cells, rods and cones in the retina, occurring at various ages. Among those are severe retinopathies, such as subtypes of RP itself that progresses with age and causes blindness in childhood and early adulthood and RP-associated diseases, such as genetic subtypes of LCA, which frequently results in loss of vision during childhood, as early as the first year of life. The latter disorders are generally characterized by severe reduction, and of ten complete loss of photoreceptor cells, rods and cones. As disclosed herein, expressing the light-sensitive protein can comprise administering to the subject a recombinant expression vector comprising a nucleotide sequence encoding the light-sensitive protein. In some embodiments, the recombinant expression vector is a viral vector. The administering can be, for example, via intraocular injection, intravitreal injection, subretinal injection, intravenous delivery, or any combination thereof.

In some embodiments, administering to the subject the recombinant expression vector comprises injecting the vector into the lateral geniculate nucleus of the subject. In some embodiments, injecting the vector into the lateral geniculate nucleus of the subject comprises injecting the vector into two or more locations of the lateral geniculate nucleus of the subject. In some embodiments, the subject is provided with a visual prosthesis before, at the same time as, or after delivery of said vector. In some embodiments, the visual prosthesis is a retinal implant, a cortical implant, a lateral geniculate nucleus implant, or an optic nerve implant. The method, in some embodiments, further comprises exposing the visual cortex of the subject to light signals Methods disclosed herein, in some embodiments, can be used in the treatment and/or restoration of at least partial vision to subjects that have lost vision due to ocular disorders (e.g., RPE-associated retinopathies, which are characterized by a long-term preservation of ocular tissue structure despite loss of function and by the association between function loss and the defect or absence of a normal gene in the ocular cells of the subject). A variety of such ocular disorders are known, including childhood onset blinding diseases, retinitis pigmentosa, macular degeneration, diabetic retinopathy, and ocular blinding diseases.

Visual information is processed through the retina through two pathways: an ON pathway which signals the light ON, and an OFF pathway which signals the light OFF. It is generally believed that the existence of the ON and OFF pathway is important for the enhancement of contrast sensitivity. The visual signal in the ON pathway is relay front ON-cone bipolar cells to ON ganglion cells. Both ON-cone bipolar cells and ON-ganglion cells are depolarized in response to light. On the other hand, the visual signal in the OFF pathway is carried from OFF-cone bipolar cells to OFF ganglion cells. Both OFF-cone bipolar cells and OFF-ganglion cells are hypopolarized in response to light. Rod bipolar cells, which are responsible for the ability to see in dim light (scotopic vision), are ON bipolar cells (depolarized in response to light). Rod bipolar cells relay the vision signal through All amacrine cells (an ON type retinal cells) to ON an OFF cone bipolar cells.

In some embodiments, the ocular disorders are refractive errors, cataracts, optic nerve disorders (e.g., glaucoma), retinal disorders, macular degeneration, diabetic eye problems, conjunctivitis, amblyopia, strabismus, or any combination thereof. The ocular disorder can be a hereditary ocular disease. Non-limiting examples of hereditary ocular disease include 3-methylglutaconic Aciduria with Cataracts; Neurologic involvement and neurtropenia; 3MC syndromes; Abetalipoproteinemia; Ablepharon-Macrostomia syndrome; Acrofacial Dysostosis; Cincinnati type; Adenomatous Polyposis of the Colon; autosomal Adrenoleukodystrophy; X-linked Adrenoleukodystrophy; Aicardi syndrome; Al Kaissi syndrome, Alagille syndrome, Aland Island eye disease; Albinism, ocular type 1; Albinism, Oculocutaneous, types I, II, III, IV, V, VI, and VII; Alkaptonuria; Alport syndrome (Collagen IV-related Nephropathies); Alström syndrome; Angiopathy, hereditary, with Nephropathy, Aneurysms, and muscle cramps; Aniridia types 1, 2, and 3; Anterior Segment Dysgenesis 6; Anterior Segment Dysgenesis 8; Anterior Segment Mesenchymal Dysgenesis; Anterior segment, brain, and facial anomalies; Apert syndrome; Aphakia, Congenital Primary; Arthrogryposis, Perthes disease, and Upward Gaze Palsy; Asphyxiating Thoracic Dysplasia 1; Ataxia and Polyneuropathy, Adult-Onset; Ataxia with Oculomotor Apraxia types 1, 2, 3, and 4; Ataxia-Telangiectasia; Autoinflammation with Arthritis and Dyskeratosis; Axenfeld-Rieger Anomaly, Plus; Axenfeld-Rieger syndrome types 1, 2, 3, and 4; Ayme-Gripp syndrome; Baker-Gordon syndrome; Baller-Gerold syndrome; Baraitser-Winter syndrome types 1 and 2; Barber-Say syndrome; Bardet-Biedl syndromes; Basal Cell Nevus syndrome; Basel-Vanagaite-S mirin-Yo sef syndrome; Beare-Stevenson syndrome; Behcet-Like Familial autoinflammatory syndrome; Behr Early Onset Optic Atrophy syndromes; Behr syndrome; Biemond syndrome II; Bietti Crystalline Corneoretinal dystrophy; Birk-Landau-Perez syndrome; Blatt Distichiasis; Blepharocheilodontic syndrome types 1 and 2; Blepharoptosis, Myopia, Ectopia Lentis; Blue Cone Monochromacy; Blue Diaper syndrome; Bornholm Eye disease; Bosma Arhinia Microphthalmia syndrome; BPES syndrome; Branchiooculofacial syndrome; Brittle Cornea syndrome 1 and 2; Brown-Vialetto-Van Laere syndrome 2; Canavan disease; Carey-Fineman-Ziter syndrome; Carpenter syndrome; Cataract and Ichthyosis; Cataracts 13, Congenital, in Adult i RBC Phenotype; Cataracts 34, 43 and 45; Cataracts 46, Juvenile-Onset; Cataracts, Anterior Polar 2; Cataracts, Anterior Polar with Guttata; Cataracts, Ataxia, Short Stature, and Mental Retardation; Cataracts, Congenital Cerulean; Cataracts, Congenital Nuclear; Cataracts, Congenital Sutural with Punctate and Cerulean Opacities; Cataracts, Congenital with Sclerocornea and Glaucoma; Cataracts, Congenital Zonular Pulverulent 1; Cataracts, Congenital Zonular Pulverulent 3; Cataracts, Congenital Zonular With Sutural Opacities; Cataracts, Congenital, and Hypomyelinating Leukodystrophy; Cataracts, Congenital, Autosomal Dominant;

Cataracts, Congenital, Autosomal Recessive 2; Cataracts, Congenital, Autosomal Recessive types 3, 4 and 5; Cataracts, Congenital, Deafness, Short Stature, Developmental Delay; Cataracts, Congenital, Facial Dysmorphism, and Neuropathy; Cataracts, Congenital, Intellectual Disability, Abnormal Striatum, and ADHD; Cataracts, Congenital, Posterior Polar; Cataracts, Congenital, Volkmann type; Cataracts, Congenital, with Brain Hemorrhage and Subependymal Calcification; Cataracts, Congenital, with Cleft Palate; Cataracts, Congenital, with Intellectual Disability; Cataracts, Congenital, With Short Stature and Minor Skeletal Anomalies; Cataracts, Congenital, X-Linked; Cataracts, Coppock-Like; Cataracts, CRYAA Mutations; Cataracts, Growth Hormone Deficiency, and Skeletal Dysplasia; Cataracts, Hearing Loss, and Neurodegeneration; Cataracts, Lamellar; Cerebellar Atrophy, Visual Impairment, and Psychomotor Retardation; Cerebral Amyloid Angiopathy; Cerebral Atrophy, Autosomal Recessive; Cerebral Cavernous Malformations; Cerebral Palsy, Spastic Quadriplegic, 3; Cerebrooculofacio skeletal syndrome; Cerebrotendinous Xanthomatosis; Charcot-Marie-Tooth disease with Glaucoma; Charcot-Marie-Tooth diseases; CHARGE syndrome; Chédiak-Higashi syndrome; Chondrodysplasia *Punctata* 2; CHOPS syndrome; Chorioretinal dysplasia, lymphedema, and microcephaly; Chorioretinal dysplasia, microcephaly, and mental retardation; Chorioretinopathy with Microcephaly 1, 2 and 3; Chorioretinopathy, Ataxia, and Hypogonadism; Choroidal dystrophy, Central Areolar 1 and 2; Choroideremia; Cleft Palate, Psychomotor Retardation, and Distinctive Facial Features; Coats Plus syndrome; Cockayne syndrome, types A and B; CODAS syndrome; Cohen syndrome; Cole-Carpenter syndrome 1 and 2; Coloboma of the Optic Nerve; Coloboma, Isolated; Coloboma, Microphthalmia, Albinism, and Deafness; Coloboma, Ptosis, Hypertelorism, and Global Delay; Color Blindness, Red-Green, Partial; Colorblindness-Achromatopsia types 2, 3, 4, and 5; Colorblindness-Tritanopia; Combined Oxidative Phosphorylation Deficiency 32; Cone dystrophy 3; Cone dystrophy, Peripheral; Cone-Rod Dystrophies, AD and AR; Cone-Rod Dystrophies, X-Linked; Cone-Rod dystrophy with Decreased Male Fertility; Cone-Rod dystrophy with Hearing Loss; Congenital disorder of Glycosylation, types Ia, Ij and Iq; Congenital Heart Defects, Dysmorphic Facies, and Intellectual Developmental disorder; Conjunctivitis, Ligneous; Cornea Plana; Cornea, Ring Dermoid; Corneal dystrophy, Avellino type; Corneal dystrophy, Band-Shaped; Corneal dystrophy, Congenital Endothelial types 1 and 2; Corneal dystrophy, Congenital Stromal; Corneal dystrophy, Endothelial X-Linked; Corneal dystrophy, Epithelial Basement Membrane; Corneal dystrophy, Fleck; Corneal dystrophy, Fuchs Endothelial, Early Onset; Corneal dystrophy, Fuchs Endothelial, Late Onset; Corneal dystrophy, Fuchs Endothelial, Late Onset 2; Corneal dystrophy, Gelatinous Drop-like; Corneal dystrophy, Granular; Corneal dystrophy, Lattice types I and II; Corneal dystrophy, Lisch Epithelial; Corneal dystrophy, Macular; Corneal dystrophy, Meesmann; Corneal dystrophy, Posterior Amorphous; Corneal dystrophy, Posterior Polymorphous types 1, 2, 3, and 4; Corneal dystrophy, Recurrent Erosions; Corneal dystrophy, Reis-Bücklers; Corneal dystrophy, Schnyder; Corneal dystrophy, Stocker-Holt; Corneal dystrophy, Subepithelial Mucinous; Corneal dystrophy, Thiel-Behnke; Cornelia de Lange syndrome; Corpus Callosum Agenesis with Facial Anomalies and Cerebellar Ataxia; Cranial Dysinnervation disorders with Strabismus and Arthrogryposis; Craniofacial-Deafness-Hand syndrome; Crouzon syndrome; Cryptophthalmos; Cystinosis; Danon disease; Dermochondrocorneal dystrophy; Developmental Delay with Short Stature, Dysmorphic Features, and Sparse Hair; Donnai-Barrow syndrome; Doyne Honeycomb Macular dystrophy; Duane Retraction syndrome types 1, 2, and 3; Duane-Radial Ray syndrome; Dysautonomia, Familial; Dyskeratosis Congenita; Dyskeratosis, Hereditary Benign Intraepithelial; Dystonia, Childhood Onset, With Optic Atrophy; Ectopia Lentis et Pupillae; Ectopia lentis, Isolated AD and AR; EDICT syndrome; EEM syndrome; Ehlers-Danlos syndrome, type VIA; Elsahy-Waters syndrome; Encephalocraniocutaneous Lipomatosis; Encephalopathy Due To Defective Mitochondrial And Peroxisomal Fission 2; Encephalopathy, Early-Onset, With Brain Atrophy and Thin Corpus Callo sum; Encephalopathy, Progressive, Early-Onset, with Brain Atrophy and Spasticity; Encephalopathy, Progressive, with Amyotrophy and Optic Atrophy; Epileptic Encephalopathy, Early Infantile types 28, 47, 48 and 58; Epileptic Encephalopathy, Infantile or Early Childhood 2; Exfoliation Glaucoma; External Ophthalmoplegia, ANTI and mtDNA Mutations; External Ophthalmoplegia, C10ORF2 and mtDNA Mutations; External Ophthalmoplegia, Facial Weakness, and Malignant Hyperthermia; External Ophthalmoplegia, POLG and mtDNA Mutations; External Ophthalmoplegia, Progressive, with mtDNA Deletions, AR 3 and AR 4; Eye Movement disorders with CACNA1A Mutations; Fabry disease; Facial Palsy, Congenital, with Ptosis and Velopharyngeal Dysfunction; Familial Acorea, Microphthalmia and Cataract syndrome; Familial Exudative Vitreoretinopathy EVR1, EVR2, EVR4, EVR5, EVR6 and EVR7; Familial Internal Retinal Membrane dystrophy; Fanilial Exudative Vitreoretinopathy, EVR3; Feingold syndrome 1; Fibrosis of Extraocular Muscles with Synergistic Divergence; Fibrosis of Extraocular Muscles CFEOM1, CFEOM2, CFEOM3C and CFEOMS; Fibrosis of Extraocular Muscles, Tukel CFEOM syndrome; Filippi syndrome; Fleck Retina of Kandori; Fleck Retina, Benign Familial; Flecked Retina syndromes; Focal Dermal Hypoplasia; Foveal Hypoplasia 1 and 2; Foveal Hypoplasia and Anterior Chamber Dysgenesis; Fraser syndromes 1, 2 and 3; Friedreich Ataxia 1; Fructose Intolerance; Fucosidosis; Fundus Albipunctatus; Gabriele-de Vries syndrome; Galactokinase Deficiency; Galactose Epimerase Deficiency; Galactosemia; Galloway-Mowat syndrome; GAPO syndrome; Gaucher disease; Gaze Palsy, Familial Horizontal, with Progressive Scoliosis 1 and 2; Gillespie syndrome; Glaucoma, Congenital Primary A, B, C, D, and E; Glaucoma, Open Angle, Juvenile and Primary; Glaucoma, pigment dispersion syndrome; GM1 Gangliosidosis; GM3 Synthase Deficiency; Goldenhar syndrome Spectrum; Goldmann-Favre syndrome; Gorlin-Chaudhry-Moss syndrome; Gracile Bone Dysplasia; Gurrieri syndrome; Gyrate Atrophy; Hallermann-Streiff syndrome; Harboyan syndrome; Heart and Brain Malformation syndrome; Heimler syndrome 1 and 2; HELIX syndrome; Hereditary Mucoepithelial Dysplasia; Hermansky-Pudlak syndrome; Histiocytic Dermatoarthritis; Homocystinuria, Beta-Synthase Deficiency; Homocystinuria, MTHFR Deficiency; Hoyeraal-Hreidarsson syndrome; Hunter syndrome (MPS II); Hurler and Scheie syndromes (MPS IH, IS, IH/S); Hyperferritinemia-Cataract syndrome; Hyperoxaluria, Primary, type I; Hyperphosphatasia with Mental Retardation syndrome 6; Hypoparathyroidism, Familial Isolated; Hypotonia, Infantile, with Psychomotor Retardation; Hypotonia, Infantile, with Psychomotor Retardation and Characteristic Facies 1, 2 and 3; Hypotrichosis with Juvenile Macular Degeneration; Hypotrichosis-Lymphedema-Telangiectasia-Renal Defect syndrome; IFAP (BRESHECK) syndrome; Immunodeficiency-Centromeric Instability-Facial Anomalies syndrome 3; Incontinentia Pigmenti; Infantile Cerebellar-Retinal Degeneration; Intellectual Disability with Dysmorphic Facies and Ptosis; Iridogoniodysgenesis and Skeletal Anomalies; Iridogoniodysgenesis, types 1 and 2; Jackson-Weiss syndrome; Jalili syndrome; Joint Laxity, Short Stature, and Myopia; Joubert syndrome and Related disorders; Kabuki syndrome 1 and 2; Kahrizi syndrome; Kaufman Oculocerebrofacial syndrome; Kearns-Sayre syndrome; Kenny-Caffey syndrome, type 2; Keratitis, hereditary; Keratoconus types 1, 2, 3, 4, and 9; Keratoconus Posticus Circumscriptus; Keratoendotheliitis Fugax Hereditaria; Keratosis Follicularis Spinulosa Decalvans, X-Linked; Keritosis Follicular Spinulosa Decalvans, AD; KID syndrome; Kniest Dysplasia; Knobloch syndrome 1, 2 and 3; Krabbe disease; Kufor-Rakeb syndrome; Lacrimal Puncta Agenesis; LCAT Deficiency; Leber Congenital Amaurosis; Leber Congenital Amaurosis with Early-Onset Deafness; Leber Optic Atrophy; LEOPARD syndrome; Leukodystrophy, Hypomyelinating, 13 and 15; Leukoencephalopathy with Vanishing White Matter; Lowe Oculocerebrorenal syndrome; Lymphedema-Distichiasis syndrome; Macrophthalmia, Colobomatous, with Microcornea; Macular Degeneration, Early-Onset; Macular dystrophy with Central Cone Involvement; Macular dystrophy, Fenestrated type; Macular dystrophy, North Carolina; Macular dystrophy, Occult; Macular dystrophy, Patterned 1, 2 and 3; Macular dystrophy, Vitelliform types 1, 2, 3, 4, and 5; Macular Edema, Autosomal Dominant Cystoid; Majewski syndrome; Mandibulofacial Dysostosis with Alopecia; Manitoba Oculotrichoanal syndrome; Mannosidosis, Alpha B; Marfan Lipodystrophy syndrome; Marfan syndrome; Marinesco-Sjogren syndrome; Maroteaux-Lamy syndrome (MPS VI); Marshall syndrome; McCune-Albright syndrome; Meckel syndrome; Meester-Loeys syndrome; Megalocornea; Megalocornea, Ectopia Lentis, and Spherophakia; MELAS syndrome; Mental Retardation AD 31, AD 34, AD 53 and AD 57; Mental Retardation, X-Linked 99, Syndromic, Female-Restricted; Microcephaly 20, Primary, Autosomal Recessive; Microcephaly, Congenital Cataracts, and Psoriasiform Dermatitis; Microcoria, Congenital; Microcornea, Myopia, Telecanthus and Posteriorly-Rotated Ears; Microphthalmia and Anophthalmia, ALDH1A3 Associated; Microphthalmia with Coloboma, AD; Microphthalmia with Coloboma, X-Linked; Microphthalmia with Limb Anomalies; Microphthalmia with Retinitis Pigmentosa; Microphthalmia, AR; Microphthalmia, Isolated, with Cataract; Microphthalmia, Syndromic 1, 10, 2, 3, 4, 5, 6, 7, 8, and 9; Mitochondrial DNA Depletion syndrome 1 and 3; Mitochondrial Short-Chain Enoyl-CoA Hydratase 1 Deficiency; Moebius syndrome; Morquio syndrome (MPS IVA); Morquio syndrome (MPS IVB); Mowat-Wilson syndrome; Multiple Endocrine Neoplasia, type IIBMultiple Mitochondrial; Dysfunctions syndrome 4; Muscular dystrophy, Congenital, with Cataracts and Intellectual Disability; Myasthenic syndromes, Congenital, Including AChR Deficiency; Myopathy, Mitochondrial Anomalies, and Ataxia; Myopia 1, X-linked, Nonsyndromal; Myopia 2, Autosomal Dominant, Nonsyndromal; Myopia 25, Autosomal Dominant, Nonsyndromic; Myopia 26, X-Linked, Female-Limited; Myopia and Deafness; Myopia, AR, with Cataracts and Vitreoretinal Degeneration; Myotonic dystrophy 1 and 2; Nance-Horan syndrome; Nanophthalmos 1, 3, AD, Plus syndrome, with Retinitis Pigmentosa, and with Retinopathy; Nemaline Myopathy 10; Neu-Laxova syndrome 1 and 2; Neuhauser syndrome; Neuraminidase Deficiency; Neurodegeneration with Ataxia, Dystonia, and Gaze Palsy, Childhood-Onset; Neurodegeneration with Brain Iron Accumulation; Neurodevelopmental disorder With or Without Seizures and Gait Abnormalities; Neurodevelopmental disorder with Progressive Microcephaly, Spasticity, and Brain Anomalies; Neurodevelopmental disorder, Mitochondrial, with Abnormal Movements and Lactic Acidosis; Neurofibromatosis types I and II; Neuronal Ceroid Lipofuscinoses; Neuropathy, Ataxia, and Retinitis Pigmentosa; Niemann-Pick disease, types C2, A and B, and C1 (D); Night Blindness, Congenital Stationary (CSNB1A, CSNB1B, CSNB1C, CSNB1E, CSNB1H, CSNB2A, CSNB2B, CSNBAD1, CSNBAD2, and CSNBAD3); Noonan syndrome; Norrie disease; Nystagmus 1, Congenital, X-linked; Nystagmus 2, Congenital, AD; Nystagmus 3, Congenital, AD; Nystagmus 4, AD; Nystagmus 5, Congenital, X-linked; Nystagmus 6, Congenital, X-linked; Nystagmus 7, Congenital, AD; Nystagmus-Split Hand syndrome; Oculoauricular syndrome (including with Hypopigmentation); Oculodentodigital Dysplasia; Oculomotor Apraxia; Oculootofacial Dysplasia; Oculopharyngeal Muscular dystrophy; Oculopharyngodistal Myopathy; Oguchi disease type 1 and 2; Optic Atrophy (1, 10, 11, 2 (X-linked), 3, Cataracts, 4, 5, 6, 7, 9, with Intellectual Disability, with Areflexia, Ataxia, Hearing Loss, with Ophthalmoplegia, Myopathy, and Neuropathy); Optic Nerve Edema, Splenomegaly, Cytopenias; Optic Nerve Hypoplasia, Bilateral; Organoid Nevus syndrome; Orofaciodigital syndrome types TX and VI; Osteogenesis Imperfecta (including type VII); Osteoporosis-Pseudoglioma syndrome; Palmoplantar Keratoderma and Woolly Hair; Pantothenate Kinase-Associated Neurodegeneration; Papillorenal syndrome; Pearson Marrow-Pancreas syndrome; PEHO syndrome; PEHO-Like syndrome; Pelizeaus-Merzbacher disease; Peroxisome Biogenesis disorders (1A (Zellweger), 1B (neonatal adrenoleukodystrophy, 3B (Infantile Refsum disease)); Peroxisomol Fatty Acyl-CoA Reductase 1 disorder; Perrault syndrome; Persistent Hyperplastic Primary Vitreous; Peters Anomaly; Peters-Plus syndrome; Pfeiffer syndrome; Pierson syndrome; Pigmentary Retinopathy with Congenital Sideroblastic Anemia; Pigmented Paravenous Chorioretinal Atrophy; Pontocerebellar Hypoplasia 11, 3 and 7; Potter disease type I; Progeroid Short Stature with Pigmented Nevi; Pseudohypoparathyroidism type 1A; Pseudoxanthoma Elasticum; Pseudoxanthoma Elasticum-Like disease; RAB18 Deficiency; Refsum disease, Adult; Retinal Arteriolar Tortuosity; Retinal Cone dystrophy 3B; Retinal detachment with Lattice Degeneration; Retinal dystrophy and Obesity; Retinal dystrophy (with Inner Retinal Abnormalities, with or without Extraocular Anomalies, with or without Macular Staphyloma, Bothnia type, and Newfoundland type); Retinal dystrophy, Cataracts, and Short Stature; Retinal Nonattachment, Congenital; Retinitis Pigmentosa 1, 2 (X-linked), 25, 3, X-Linked, 38, 42, 47, 71, 72, 75, 76, 77, 78, 79, 80, and 81; Retinitis Pigmentosa and Mental Retardation; Retinitis Pigmentosa with Ataxia; Retinitis Pigmentosa With or Without Skeletal Anomalies; Retinitis Pigmentosa (AD; AR; deafness, Mental Retardation and Hypogonadism; Hearing Loss, Ataxia, Cataract, and Polyneuropathy; RDH11 syndrome); Retinitis *Punctata Albescens*; Retinoblastoma; Retinopathy with Neutropenia; Retinoschisis, Juvenile; Revesz syndrome; Rhizomelic Chondrodysplasia *Punctata*; Roberts syndrome; Rosenthal-Kloepfer syndrome; Rothmund-Thomson syndrome; Rubinstein-Taybi syndrome 1 and 2; Saethre-Chotzen syndrome; Sandhoff disease; Sanfilippo syndrome (MPS IIIA, B, C, D); Schurrs-Hoeijmakers syndrome; Sclerocornea; Sengers syndrome; Senior-Loken syndromes; Septooptic Dysplasia; Setleis syndrome; Short Stature, Hearing Loss, Retinitis Pigmentosa, and Distinctive Facies; SHORT syndrome; Short-Rib Thoracic Dysplasia 9; Sickle Cell Anemia; Singleton-Merten syndrome 1 and 2; Sjogren-Larsson syndrome; Smith-Lemli-Opitz syndrome; Smith-Magenis syndrome; Sorsby Macular Coloboma syndrome; Sorsby Pseudoinflammatory Fundus dystrophy; Spastic Ataxia (2; 4, mtPAP Deficiency; 6, Charlevoix-Saguenay type; 7, with Miosis; 8, Autosomal Recessive, with Hypomyelinating Leukodystrophy; and Optic Atrophy, Mental Retardation); Spastic Paraplegia (including types 11; 15; 2; 46; 5A; 7; 74; 75; 78; with Psychomotor Retardation and Seizures, with Intellectual Disability, Nystagmus, and Obesity; with Optic Atrophy, and Neuropathy); Spherophakia and Metaphyseal Dysplasia; Spherophakia with Inguinal Hernia; Spherophakia, Isolated; Spinocerebellar Ataxia (including types 1, 18, 3, 37, 38, 42, 7, Autosomal Recessive 7, and Infantile-Onset); Spondyloepiphyseal Dysplasia Congenita; Spondylometaphyseal Dysplasia, Axial; Spondyloocular syndrome; Stargardt disease; Stickler syndrome (including types I, II and IV); Strøomme syndrome; Sulfite Oxidase Deficiency; Sweeney-Cox syndrome; Takenouchi-Kosaki syndrome; Tangier disease; Tay-Sachs disease; Temtamy syndrome; Tenorio syndrome; Treacher Collins-Franceschetti syndrome; Trichomegaly Plus syndrome; Tuberous Sclerosis 1 and 2; Tyrosinemia, type II; Usher syndrome types I, II, III and IV; Vici syndrome; Vitreoretinal Degeneration, Snowflake type; Vitreoretinochoroidopathy; Vitreoretinopathy with Epiphyseal Dysplasia; Von Hippel-Lindau syndrome; Waardenburg syndrome types 1, 2, 3 and 4; Wagner syndrome; Walker-Warburg syndrome; Watson syndrome; Weill-Marchesani syndrome 1; Weill-Marchesani syndrome 2; Weill-Marchesani-Like syndrome; Wildervanck syndrome; Williams syndrome; Wilson disease; Wolfram syndrome 1 and 2; and Zhu-Tokita-Takenouchi-Kim syndrome ("ZTTK syndrome").

The methods and compositions disclosed herein can restore and/or enhance visual function in a subject in need thereof. In some embodiments, the restoration and/or the enhancement of visual function provides for patterned vision and image recognition by the subject. The image recognition can be, for example, of a static image or a pattern. The light intensity that can be provided by the restoration and/or enhancement for image recognition can vary, for example, it can be at a light intensity of from about $10^4$ W/cm$^2$ to about 1 W/cm$^2$. In some embodiments, the image recognition is of a moving image or a pattern.

The methods and compositions disclosed herein can restore and/or enhance vision in a subject in need thereof. The method, for example, can comprise measuring vision before and/or after administering a nucleic acid molecule (e.g., a vector) comprising a coding sequence for a light-sensitive protein (e.g., the engineered ChR). Many methods are known in the art to measure vision, including the following visual responses: (1) a light detection response by the subject after exposure to a light stimulus—in which evidence is sought for a reliable response of an indication or movement in the general direction of the light by the subject individual when the light it is turned on is; (2) a light projection response by the subject after exposure to a light stimulus in which evidence is sought for a reliable response of indication or movement in the specific direction of the light by the individual when the light is turned on; (3) a light resolution by the subject of a light vs. dark patterned visual stimulus, which measures the subject's capability of resolving light vs dark patterned visual stimuli as evidenced by: (a) the presence of demonstrable reliable optokinetically produced mystagmoid eye movements and/or related head or body movements that demonstrate tracking of the target, and/or (b) the presence of a reliable ability to discriminate a pattern visual stimulus and to indicate such discrimination by verbal or non-verbal means, including, for example pointing, or pressing a bar or a button; and (4) an electrical recording of a visual cortex response to a light flash stimulus or a pattern visual stimulus, which is an endpoint of electrical transmission from a restored retina to the visual cortex. Measurement may be by electrical recording on the scalp surface at the region of the visual cortex, on the cortical surface, and/or recording within cells of the visual cortex.

The methods and compositions disclosed herein can be used in combination with other forms of vision therapy, including the use of visual prostheses. Visual prostheses include, but are not limited to, retinal implants, cortical implants, lateral geniculate nucleus implants, optic nerve implants, and any combination thereof. For example, the subject being treated with the methods and/or compositions disclosed herein can be provided with a visual prosthesis before, at the same time as, or after the treatment. In some embodiments, the methods and/or compositions disclosed herein are used in combination of one or more visual stimulation techniques used in, e.g., low vision rehabilitation.

Some embodiments provide a method for treating a subject suffering from a retinal degenerative or neurodegenerative disease. The method comprises, for example, expressing a light-sensitive protein (e.g., the ChRs disclosed herein) in the subject or administering the light-sensitive protein to the subject. Expressing the light-sensitive protein in the subject comprises, in some embodiments, delivering a nucleic acid molecule encoding the light-sensitive protein (e.g., a viral expression vector with the coding sequence of the light-sensitive protein) to the subject, thereby expressing the light-sensitive protein in the subject. In the method disclosed herein, a therapeutically effective amount of the light-sensitive protein and/or the nucleic acid molecule encoding the light-sensitive protein can be administered to the subject. The administration can be conducted, for example, via injection(s).

Provided herein are light-sensitive proteins (e.g., ChRs) with improved properties and characteristics that enhance, among other things, optogenetic techniques. For example, some of the light-sensitive protein provide greater unitary conductance, sodium specificity, or the enhancement of the short-wavelength sensitivity, by inducing a blueshift in absorption maxima. Optogenetic techniques involve the introduction of light-activated channels and enzymes that allow manipulation of neural activity and control of neuronal function. In some embodiments, the disclosed methods and compositions can be introduced into cells and facilitate the manipulation of the cells' activity and function. The cells can be retinal neurons, for example, one or more of ON- and OFF-type retinal ganglion cells, retinal rod bipolar cells, amacrine cells, and ON and OFF retinal cone bipolar cells, or any combination thereof.

Disclosed methods and/or compositions can be used in, among other things, retinal gene therapy for mammals. For example, a genetically engineered ocular cell is produced by contacting the cell with an exogenous nucleic acid under conditions in which the exogenous nucleic acid is introduced to the cell for expressing one or more of the light-sensitive proteins disclosed herein. In some embodiments, the introduction and/or expression of the light-sensitive protein(s) to the cell, for example an monocular neuronal cell or binocular neuronal cell, result in sensitivity to the retinas and restoring one or more aspects of visual responses and functional vision to a subject, for example a subject suffering from macular degeneration. Without being limited to any particular theory, it is believed that by restoring light sensitivity to a retina lacking this capacity, due to disease, a mechanism for the most basic light-responses that are required for vision is provided. In some embodiments, a blue-shifted ChR is inserted into the retinal neurons that survived after the rods and cones have died in an area or portion of the retina of a subject. In some embodiments, a blue-shifted ChR is inserted into retinal interneurons. These cells then can become light sensitive and send signals via the optic nerve and higher order visual pathways to the visual cortex where visual perception occurs.

In some embodiments, expressing the light-sensitive protein in the subject restores or enhances the photosensitivity of the retinal neurons in the subject, and/or the photosensitivity of a retina or a portion thereof of the subject. It is advantageous, in some embodiments, for the light-sensitive protein to be expressed in retinal cells, monocular neuronal cells, binocular neuronal cells, electrically active cells, or any combination thereof in the subject. In some embodiments, the one or more retinal cells comprises retinal ganglion cells, retinal neurons or any combination thereof.

In some embodiments, the subject suffers from blindness or vision loss, and optionally the blindness or visional loss is a result of a degenerative diseases. In some embodiments, one or more photoreceptor cells of the subject are degenerating or have degenerated. In some embodiments, the subject suffered and/or is suffering from retinal detachment and/or photoreceptor loss due to trauma or head injury.

In some embodiments, the methods and compositions disclosed herein can be used to treat or ameliorate one or more neuronal disorders, such as neuropathic pain. In some embodiments, the neuronal disorder is affected by light sensitivity of the subject. In some embodiments, the neuronal disorder is related to a behavior abnormality controlled or affected by light sensitivity of the subject. In some embodiments, the neuronal disorder is affected by light. In some embodiments, the neuronal disorder is related to a behavior abnormality controlled or affected by light. In some embodiments, the neuronal disorder has one or more symptoms affected by light sensitivity of the subject. In some embodiments, the neuronal disorder has one or more symptoms controlled or affected by light sensitivity of the subject. In some embodiments, at least one or more symptoms of the neuronal disorder are affected by light.

The method can further comprise delivering light to the subject, and optionally delivery light comprises placing a plurality of fiber optic-cables on the skull of the subject. In some embodiments, the light activates the light-sensitive protein, thereby activating light-dependent neuronal cells in the subject. In some embodiments, the method comprises effecting light-controlled neuronal activation, light-induced behavioral control, or both in the subject. In some embodiments, the effecting light-controlled neuronal activation, light-induced behavioral control, or both is performed without disruption to any tissues in the subject. In some embodiments, the effecting light-controlled neuronal activation, light-induced behavioral control, or both is performed without disruption to any tissues in the subject. In some embodiments, the effecting light-controlled neuronal activation, light-induced behavioral control, or both is performed without disruption to one or more of the tissues in the subject. The tissues can be, or can comprise, brain tissue, eye tissue, or both.

EXAMPLES

Some aspects of the embodiments discussed above are disclosed in further detail in the following examples, which are not in any way intended to limit the scope of the present disclosure.

Experimental Material and Methods

The following experimental methods were used for Examples 1-7 described below.

Construct Design and Cloning

The design, construction, and characterization of the recombination library of chimeras is described in detail in Bedbrook et al. (Proc Natl Acad Sci USA., 2017, 114(13): E2624-E2633). The 10-block contiguous and 10-block non-contiguous recombination libraries were designed and built using SCHEMA recombination as described in Bedbrook et al. Software packages for calculating SCHEMA energies are openly available at cheme.che.caltech.edu/groups/fha/Software.htm. Each chimeric ChR variant in these libraries is composed of blocks of sequence from the parental ChR (CsChrimR, C1C2, and CheRiff), including chimeras with single-block swaps (chimeras consisting of 9 blocks of one parent and a single block from one of the other two parents) and multi-block-swap chimera sequences.

Figure 5A:
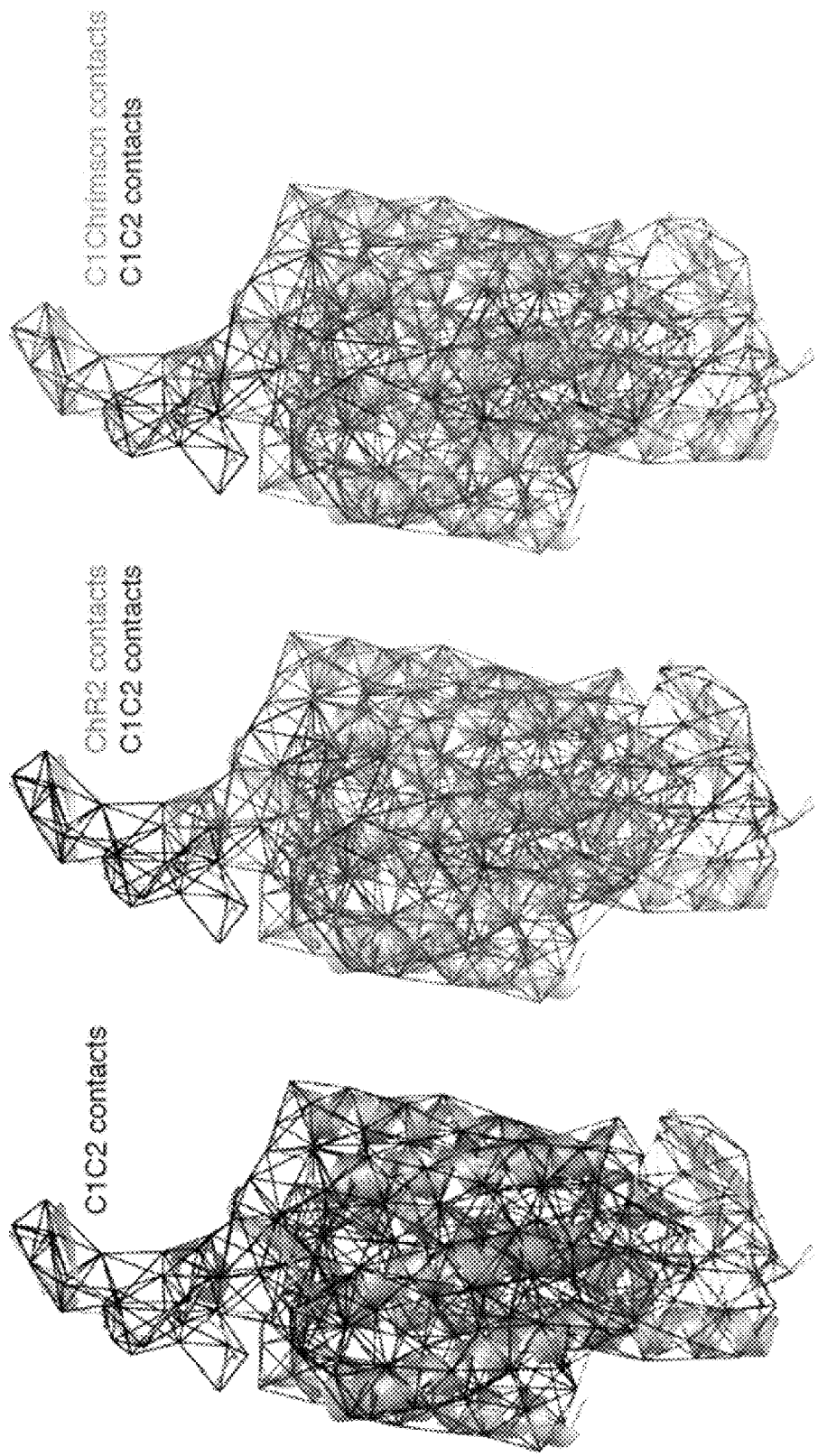
FIGS. 5A-D show comparison of ChR regression models built using different contact maps.
Figure 5B:
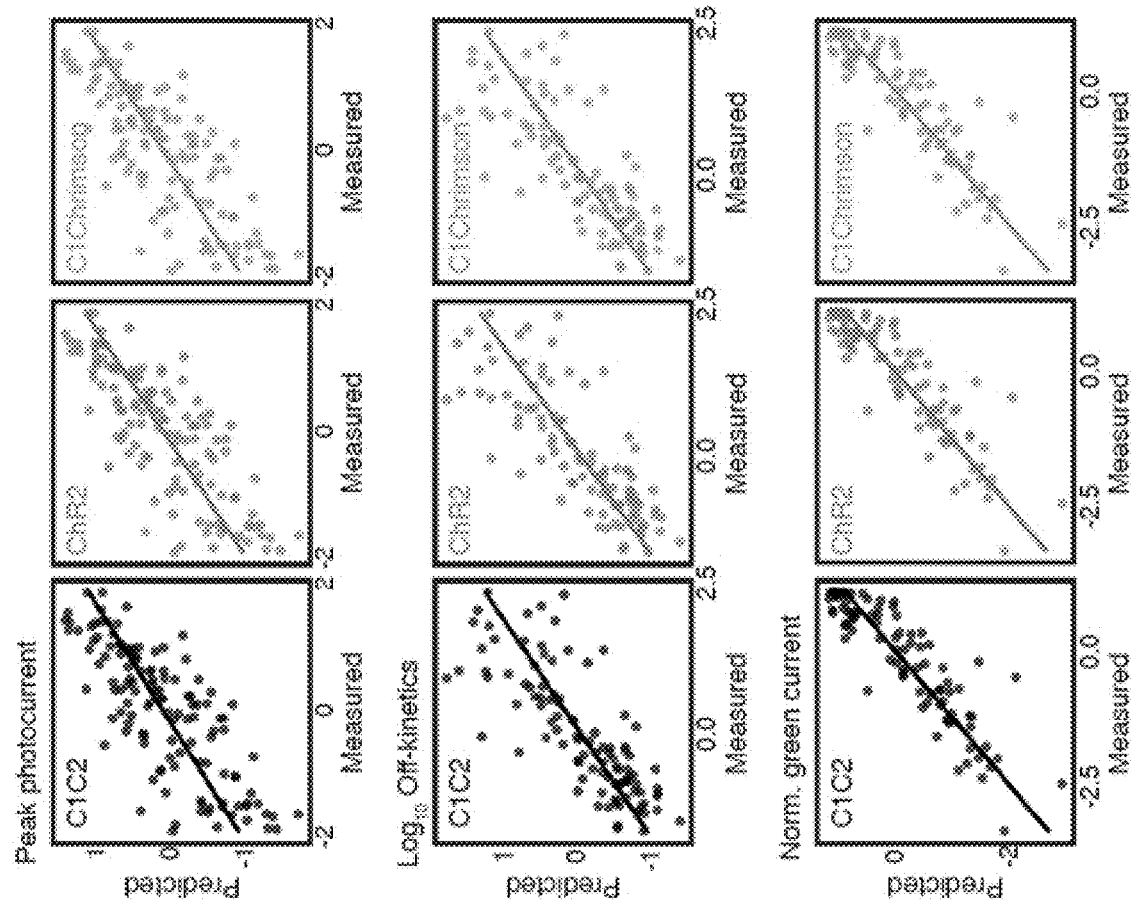
Figure 5C:
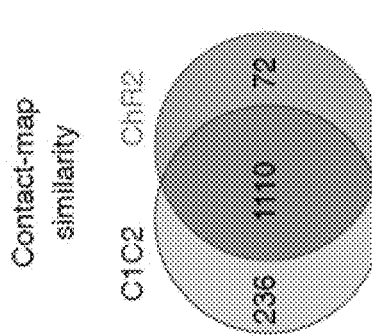
Figure 5C:
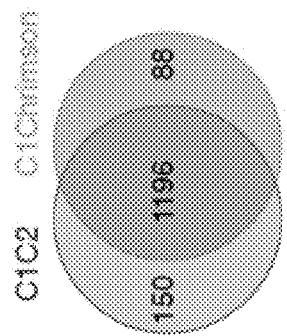
Figure 5D:
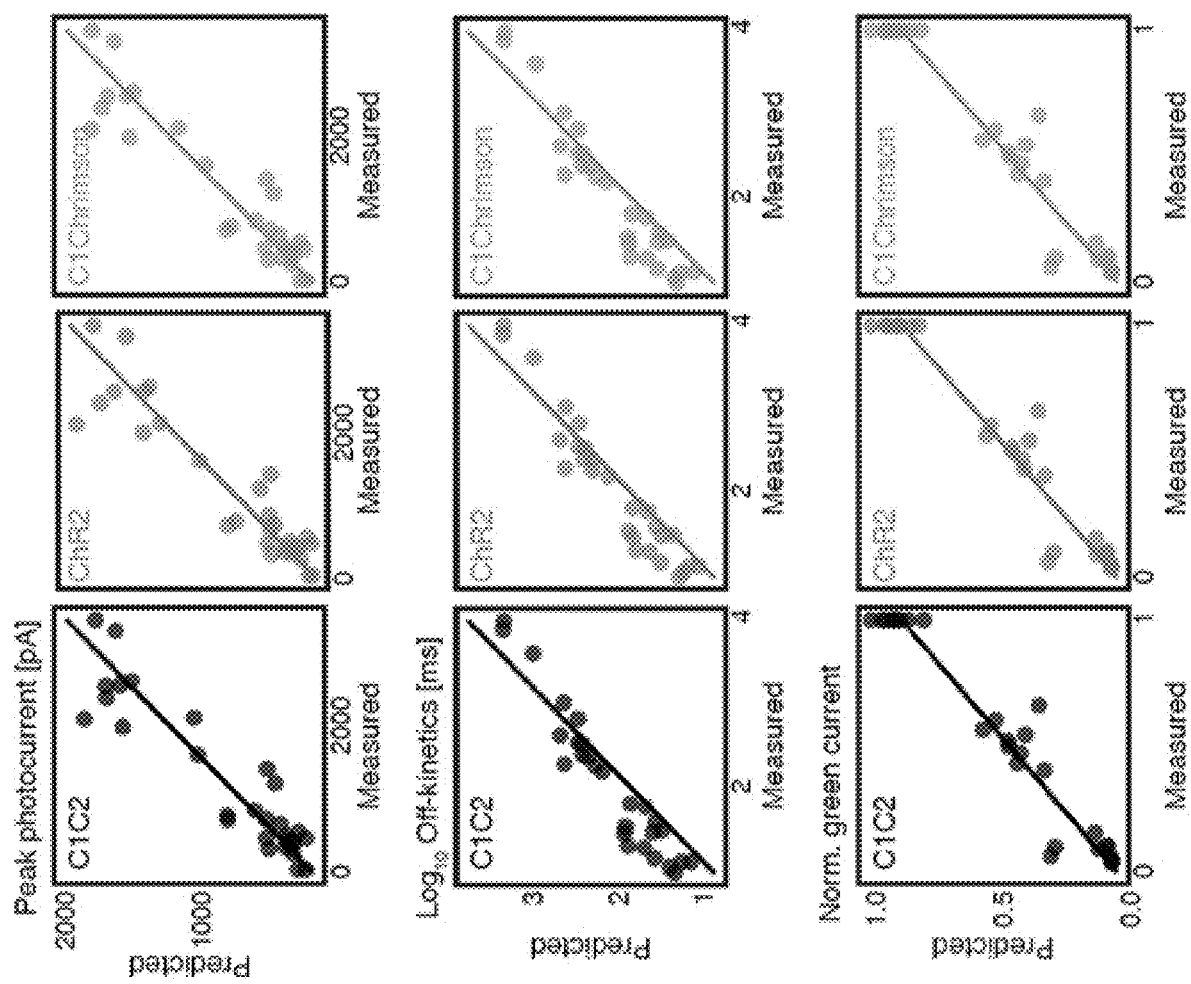

Selected ChR variant genes were inserted into a constant vector backbone [pFCK from Addgene plasmid #51693] with a CMV promoter, Golgi export trafficking signal (TS) sequence (KSRITSEGEYIPLDQIDINV (SEQ ID NO: 199)), and fluorescent protein (mKate). All ChR variants contain the SpyTag sequence following the N-terminal signal peptide for the SpyTag/SpyCatcher labeling assays used to characterize ChR membrane localization. The C1C2 parent for the recombination libraries is mammalian codon-optimized. ChR variant sequences used in this study are provided in the Sequence Listing submitted herewith. All selected ChR genes were synthesized and cloned in the pFCK mammalian expression vector by Twist Bioscience (San Francisco, CA). For visualization, sequence alignment between C1C2 and engineered ChRs were created using ClustalΩ and visualized using ENDscript (FIGS. 5C and 5D).

For characterization in neurons, selected ChR variants [ChRger1, ChRger2, ChRger3, CoChR, and hChR2 (H134R)] were inserted into a pAAV-hSyn vector backbone [Addgene plasmid #26973], a pAAV-CamKIIa vector backbone [Addgene plasmid #51087], and a pAAV-CAG-DIO vector backbone [Addgene plasmid #104052]. In all backbones, each ChR was inserted with a TS sequence and fluorescent protein (eYFP).

HEK293T Cell and Primary Neuronal Cultures

The culturing and characterization ChRs in HEK cells is described in Bedbrook et al. Briefly, HEK cells were cultured at 37° C. and 5% $CO_2$ in D10 [DMEM supplemented with 10% (vol/vol) FBS, 1% sodium bicarbonate, and 1% sodium pyruvate]. HEK cells were transfected with purified ChR variant DNA using FuGENE®6 reagent according to the manufacturer's (Promega) recommendations. Cells were given 48 hours to express the ChRs before photocurrent measurements. Primary hippocampal neuronal cultures were prepped from C57BL/6N mouse embryos 16-18 days post-fertilization (E16-E18 Charles-River Labs) and cultured at 37° C. in the presence of 5% $CO_2$ in Neurobasal media supplemented with glutamine and B27. Cells were transduced 3-4 days after plating with rAAV-PHP.eB packaging ChR2(H134R), CoChR, ChRger1, ChRger2, or ChRger3. Whole-cell recordings were performed 5-10 days after transduction.

Patch-Clamp Electrophysiology

Whole-cell patch-clamp and cell-attached recordings were performed in transfected HEK cells, transduced cultured neurons, and acute brain slices to measure light-activated inward currents or neuronal firing. For electrophysiological recordings, cultured cells were continuously perfused with extracellular solution at room temperature (in mM: 140 NaCl, 5 KCl, 10 HEPES, 2 $MgCl_2$, 2 $CaCl_2$, 10 glucose; pH 7.35) while mounted on the microscope stage. For slice recordings, 32° C. artificial cerebrospinal fluid (ACSF) was continuously perfused over slices. ACSF contained 127 mM NaCl, 2.5 mM KCl, 25 mM $NaHCO_3$, 1.25 mM $NaH_2PO_4$, 12 mM d-glucose, 0.4 mM sodium ascorbate, 2 mM $CaCl_2$, and 1 mM $MgCl_2$ and was bubbled continuously with 95% oxygen/5% $CO_2$. Firing and photocurrent measurements were performed in the presence of 3 mM kynurenic acid and 100 µM picrotoxin to block optically evoked ionotropic glutamatergic and GABAergic currents, respectively.

Patch pipettes were fabricated from borosilicate capillary glass tubing (1B150-4; World Precision Instruments) using a model P-2000 laser puller (Sutter Instruments) to resistances of 3-6 MΩ. Pipettes were filled with K-gluconate intracellular solution containing the following (in mM): 134 K gluconate, 5 EGTA, 10 HEPES, 2 $MgCl_2$, 0.5 $CaCl_2$, 3 ATP, and 0.2 GTP. Whole-cell patch-clamp and cell-attached recordings were made using a Multiclamp 700B amplifier (Molecular Devices), a Digidata 1440 digitizer (Molecular Devices), and a PC running pClamp (version 10.4) software (Molecular Devices) to generate current injection waveforms and to record voltage and current traces.

Figure 14A:
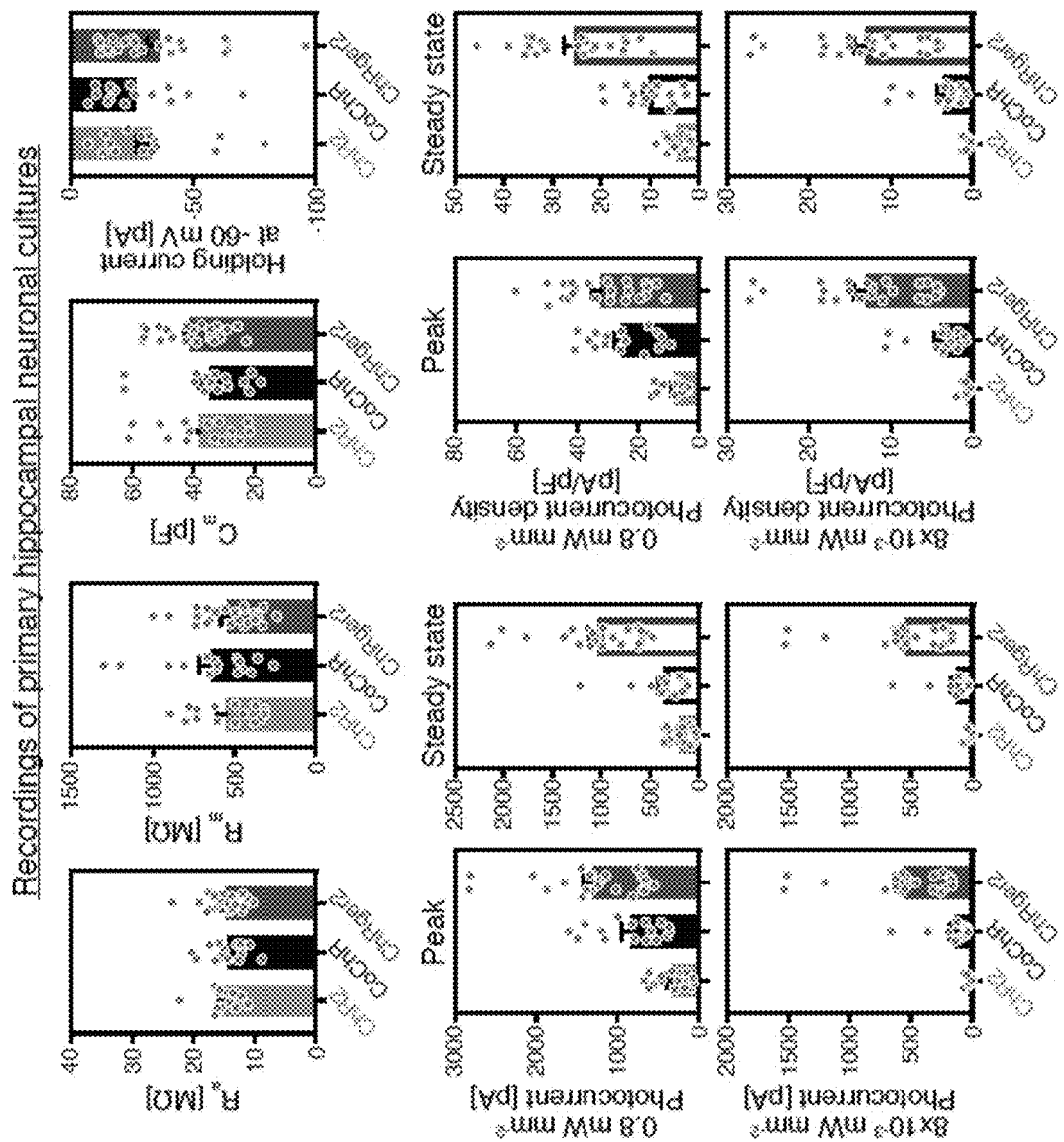
FIGS. 14A-B show detailed comparison of ChRger2 with ChR2(H134R) and the high performance CoChR in neurons in culture and acute slice. ChRger2-expressing neurons' passive membrane properties, photocurrents, and photocurrent density in (FIG. 14A) culture and (FIG. 14B) acute slice (in the PFC) compared with CoChR and ChR2(H134R). Access resistance ($R_a$), membrane resistance ($R_m$), membrane capacitance ($C_m$), leak current (holding at −60 mV), and resting membrane potential (RMP) for recorded cells expressing ChRger2, CoChR, or ChR2(H134R) show no significant difference (one-way ANOVA). Recorded neurons in culture have near zero holding current when held at −60 mV, indicating that these cells were not depolarized. With 0.8 mW mm$^{-2}$ intensity 485 nm light, ChRger2 produces significantly larger peak photocurrent density than ChR2 (H134R) and significantly larger steady-state photocurrent density than both ChR2(H134R) and CoChR (Kruskal-Wallis test with Dunn's post hoc test). With 8×10$^{-3}$ mW mm$^2$ intensity 485 nm light, ChRger2 produces significantly larger peak and steady-state photocurrent density than both ChR2(H134R) and CoChR (Kruskal-Wallis test with Dunn's post hoc test). Neuronal culture: ChR2(H134R), n=16 cells; CoChR, n=17 cells; ChRger2, n=24 cells. Acute slice: ChR2(H134R), n=11 cells; CoChR, n=14 cells; ChRrger2, n=13 cells. Plotted data are mean±SEM.
Figure 14B:
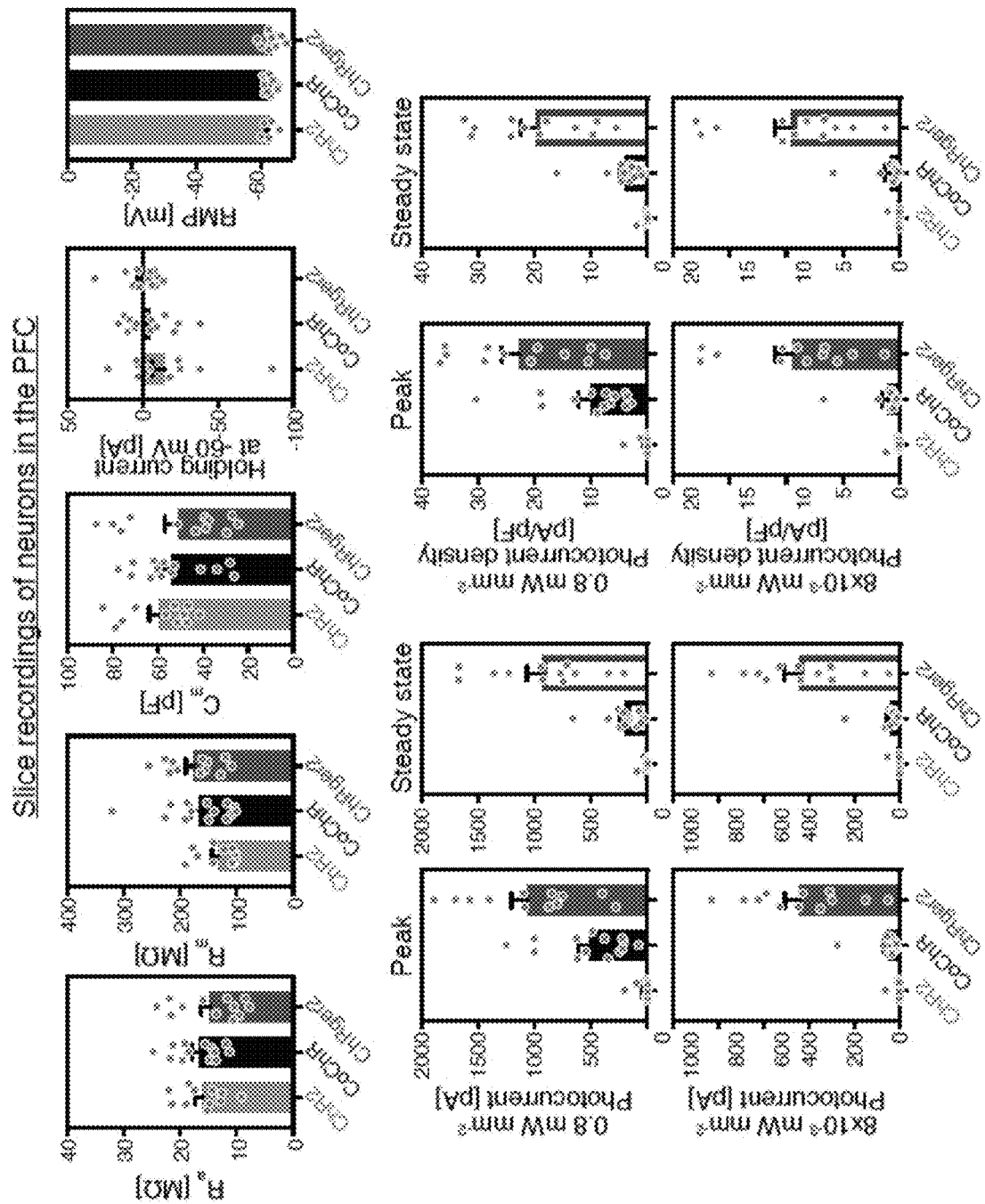

Photocurrents were recorded from cells in voltage clamp held at −60 mV. Neuronal firing was measured in current clamp mode with current injection for a −60 mV holding potential. Access resistance ($R_a$) and membrane resistance ($R_m$) were monitored throughout recording, and cells were discarded if $R_a$ or $R_m$ changed more than 15%. During ChR variant functional screening in HEK cells, photocurrents were recorded from cells that passed our recording criteria: $R_m$>200 MΩ and holding current >−100 pA. Our measured membrane properties of ChR expressing neurons were consistent with previous literature of opsin-expressing cells and are also consistent with previous reports of properties of cultured hippocampal neurons and PFC neurons in slice (FIG. 14A-B). For cell culture experiments, the experimenter was blinded to the identity of the ChR being patched but not to the fluorescence level of the cells. For acute slice recordings, the experimenter was not blinded to the identity of the ChR.

Light Delivery and Imaging

Figure 9A:
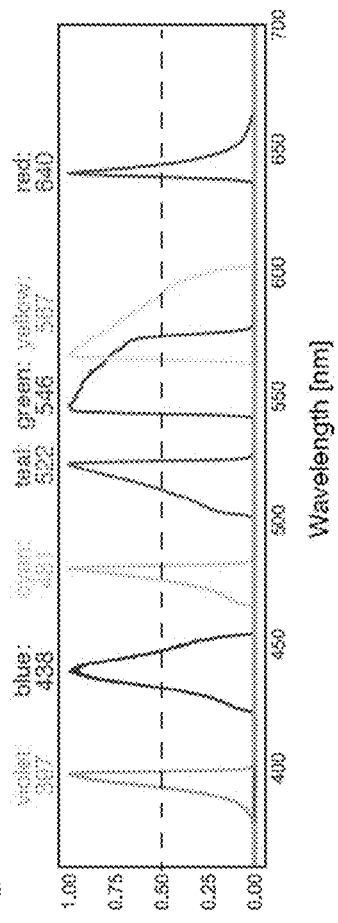
FIGS. 9A-B show characterization of activation spectra for select engineered ChR variants.
Figure 9B:
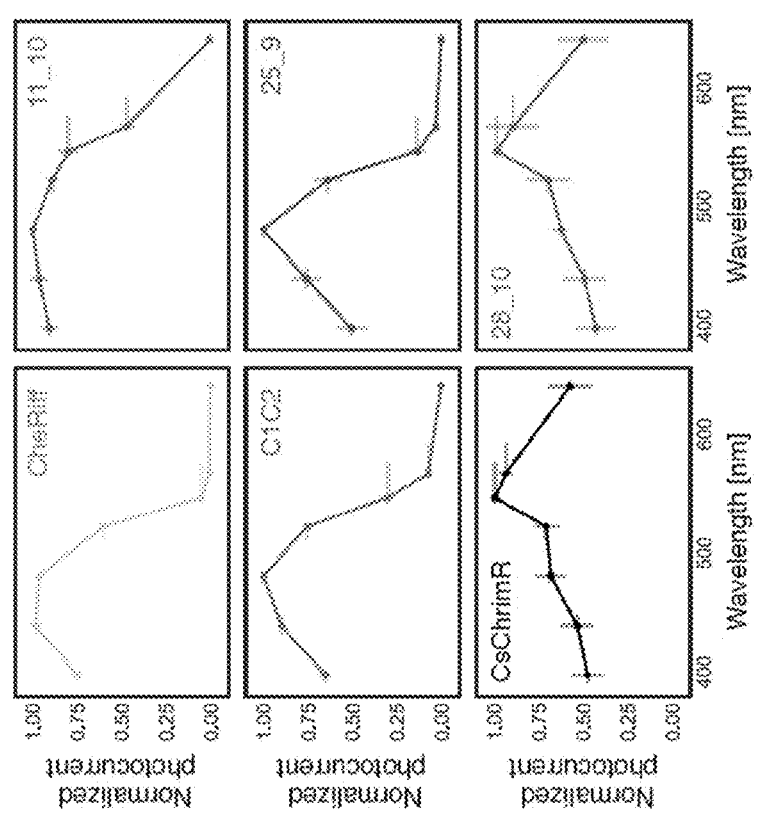
Figure 10A:
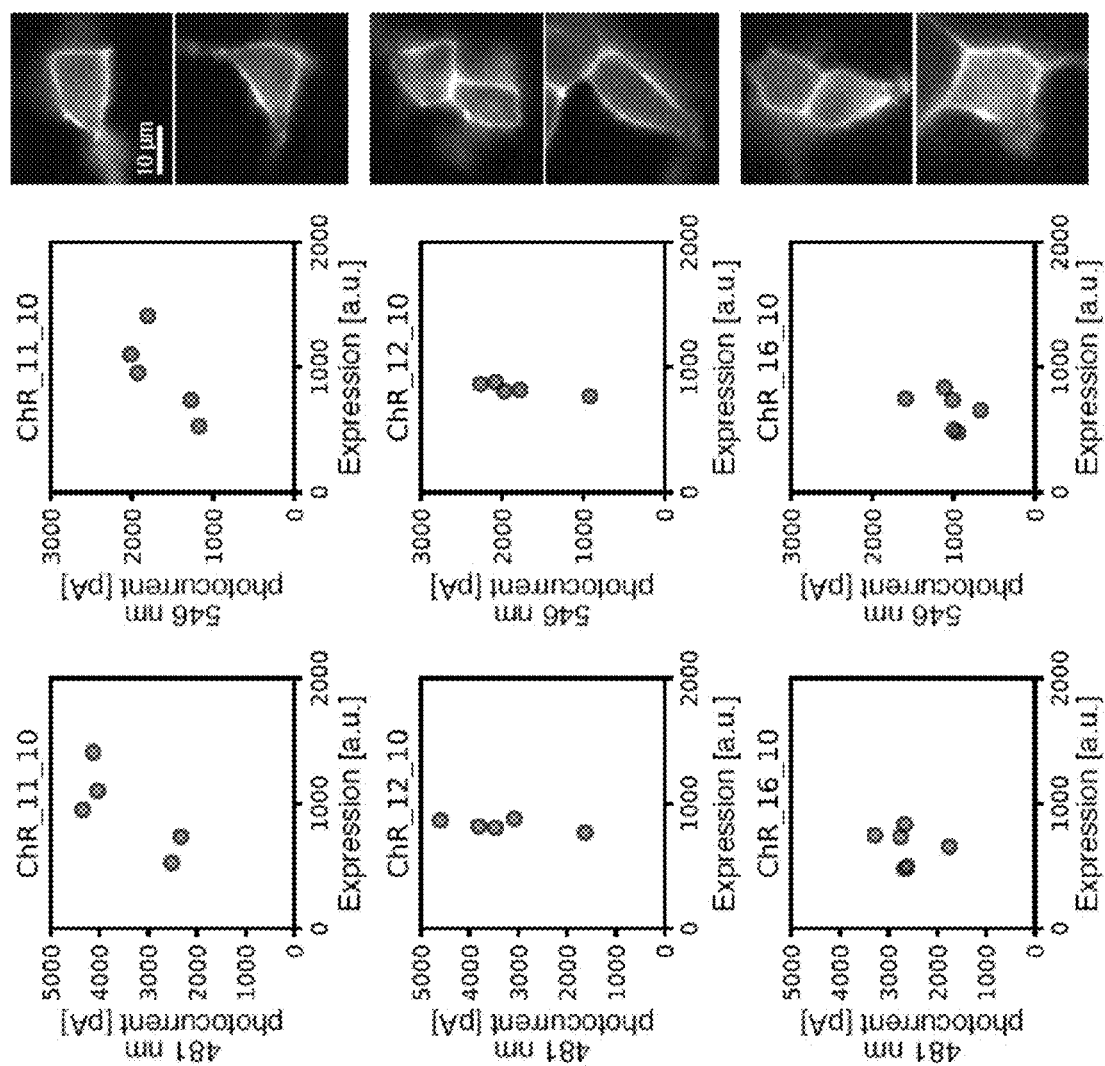
FIGS. 10A-L show correlation between photocurrent strength and expression of ChR variants. Plot of measured photocurrent strength versus expression in HEK cells for each ChR variant. Each point is an individual cell. For each variant, images of two representative cells shows localization. To highlight ChR variant localization patterns, contrast in each image was adjusted so that localization can be compared for both high-expressing and low-expressing variants. Thus, images are not contrast matched and fluorescence brightness in images is not an indicator of relative expression level across variants.
Figure 10B:
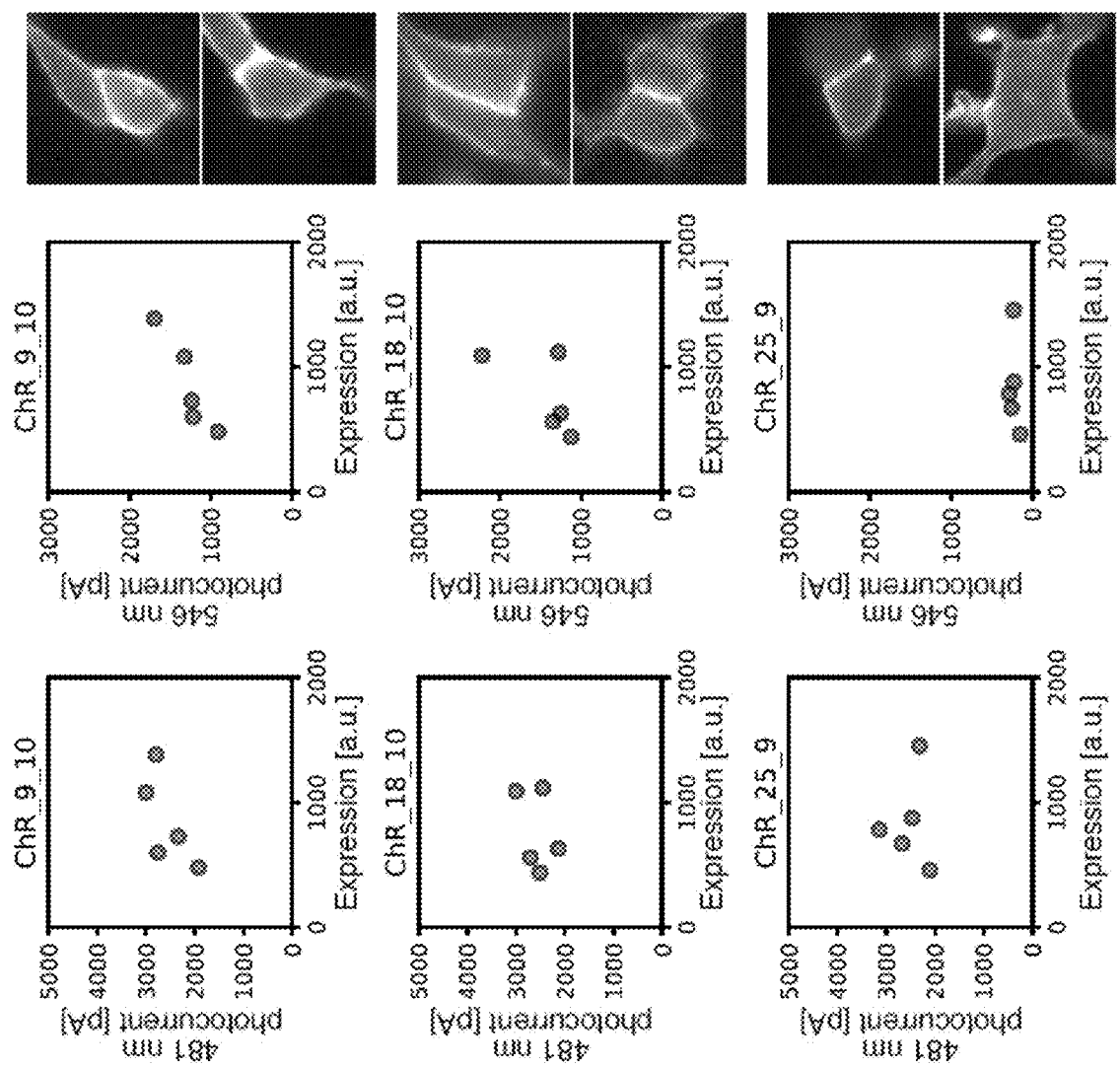
Figure 10C:
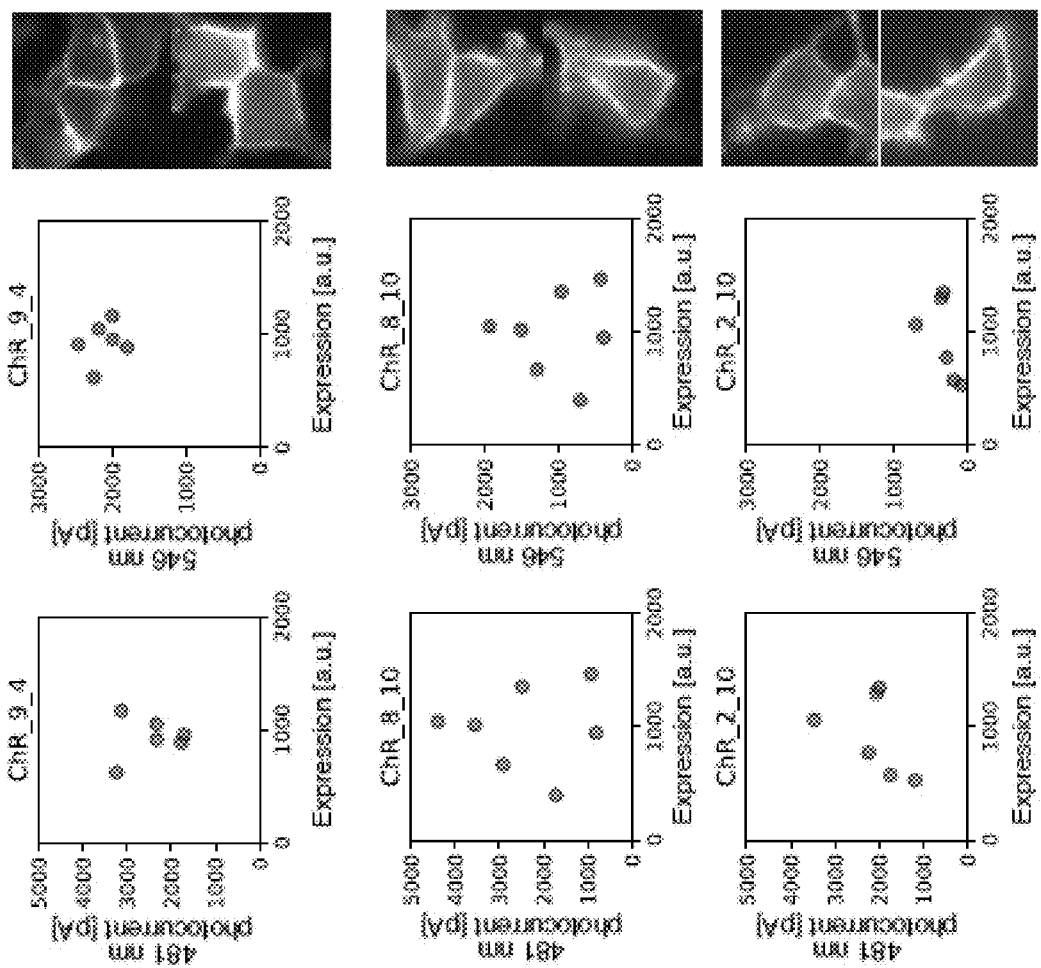
Figure 10D:
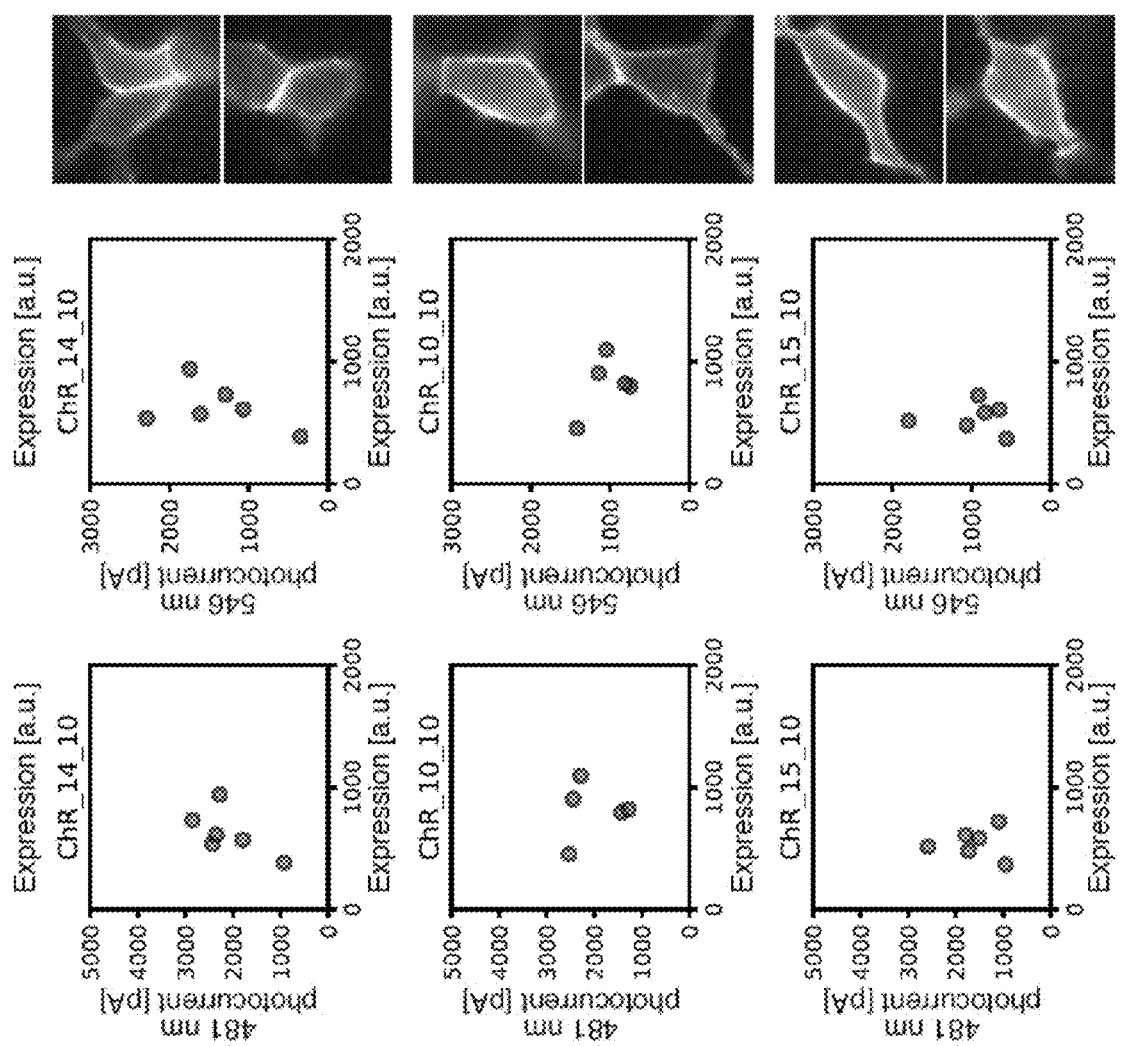
Figure 10E:
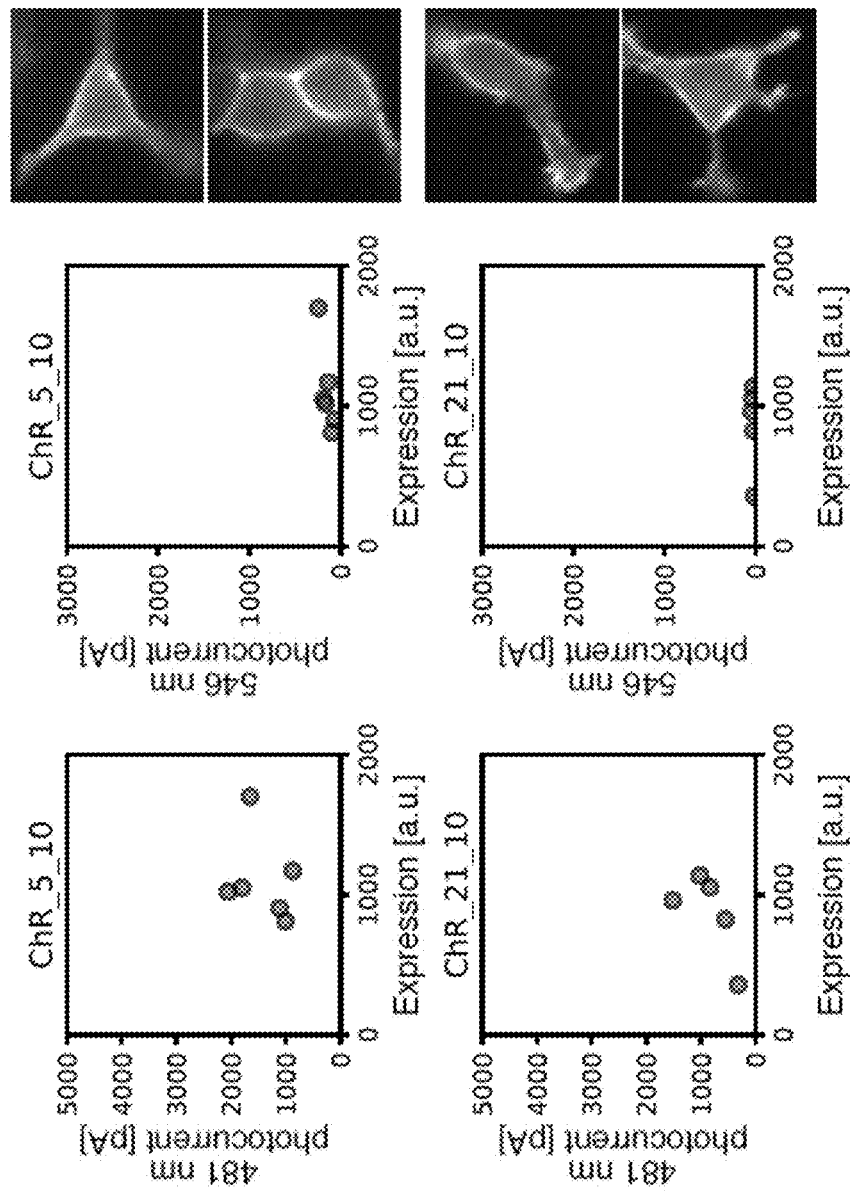
Figure 10F:
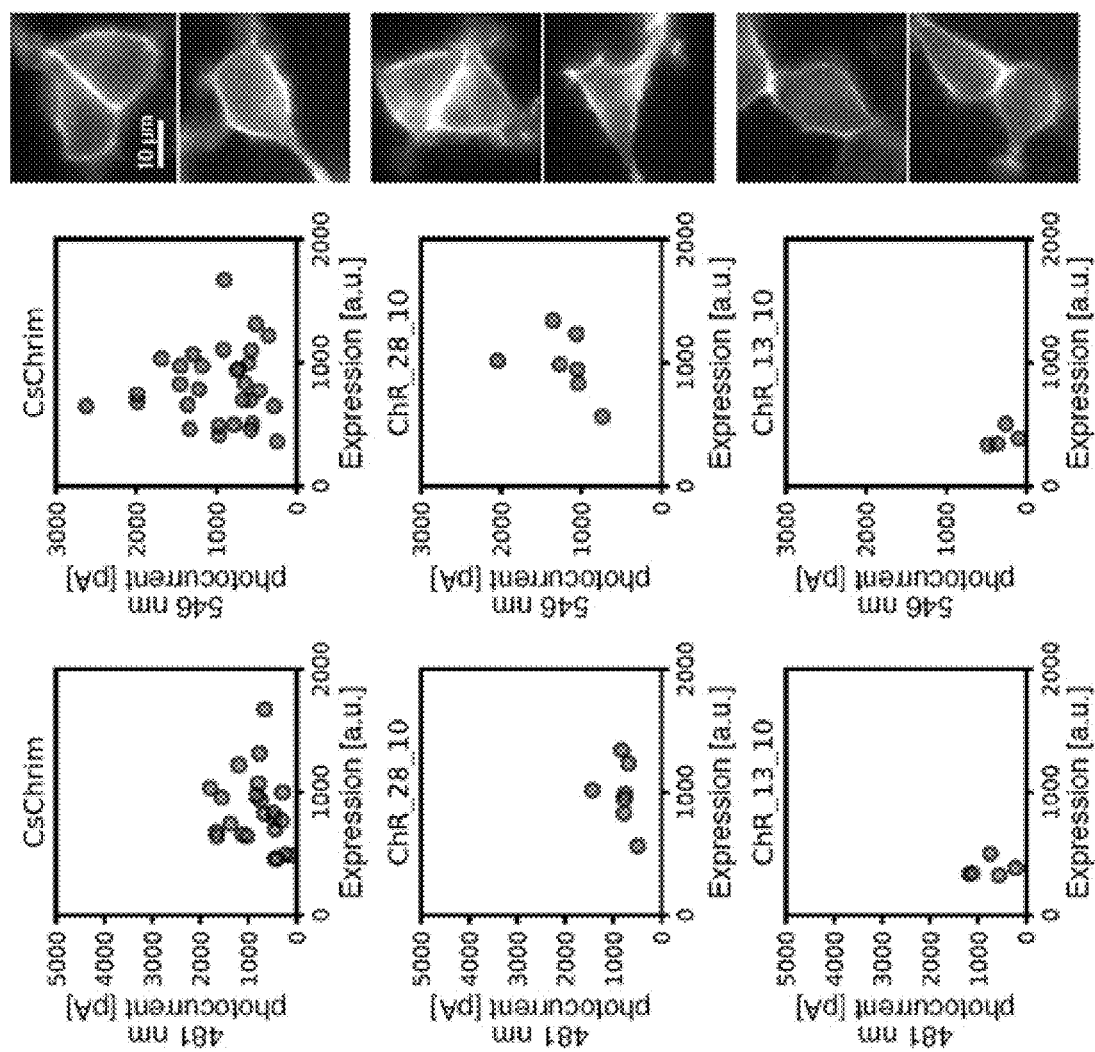
Figure 10G:
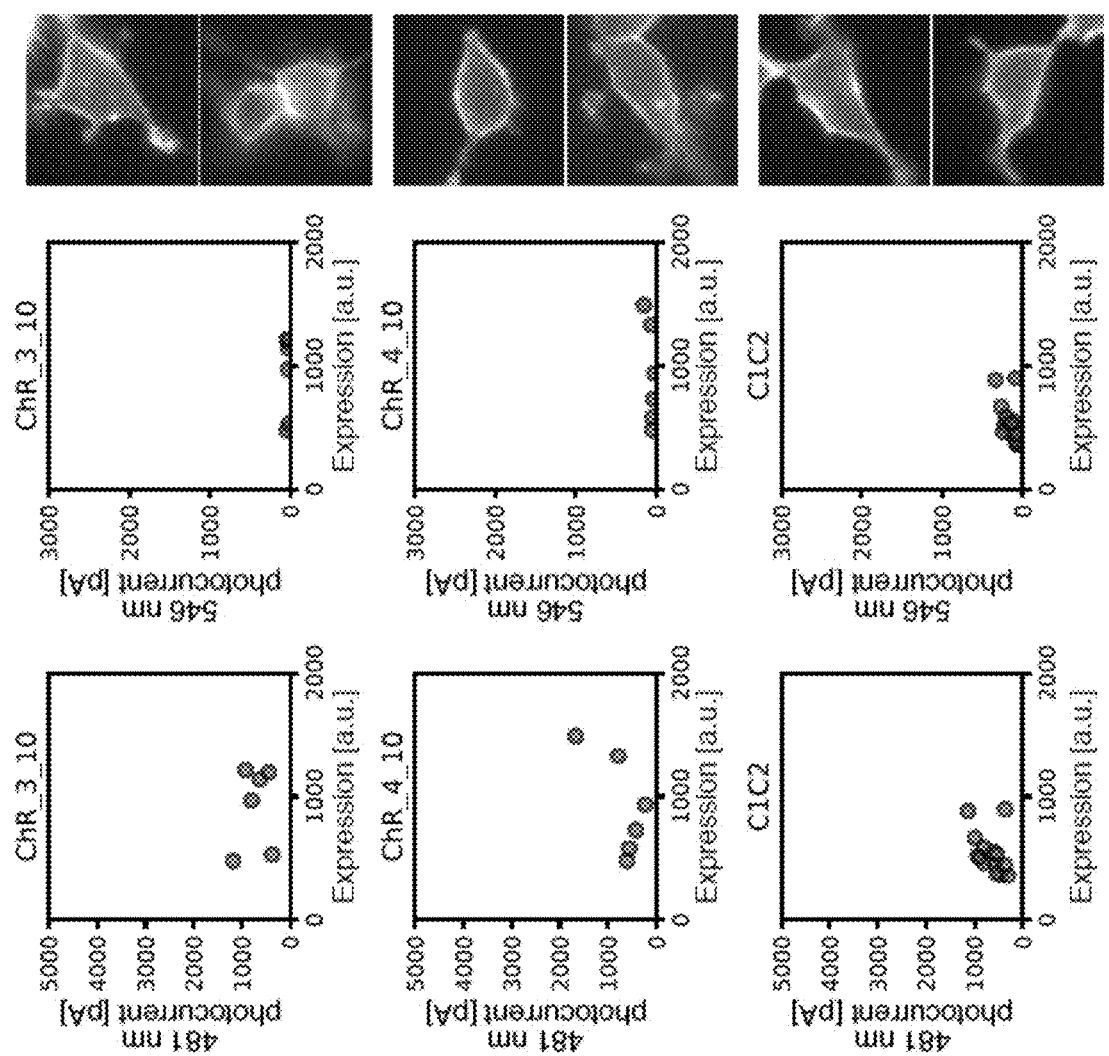
Figure 10H:
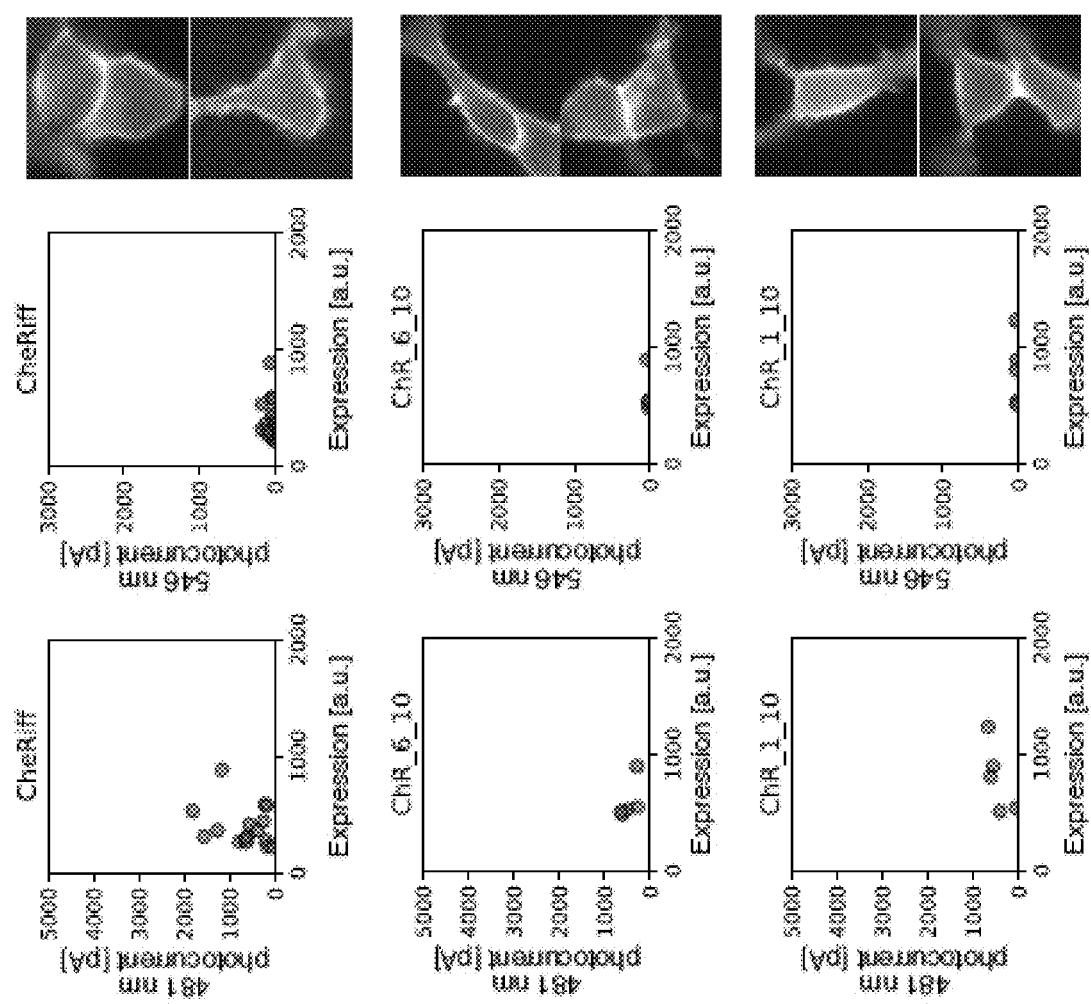
Figure 10I:
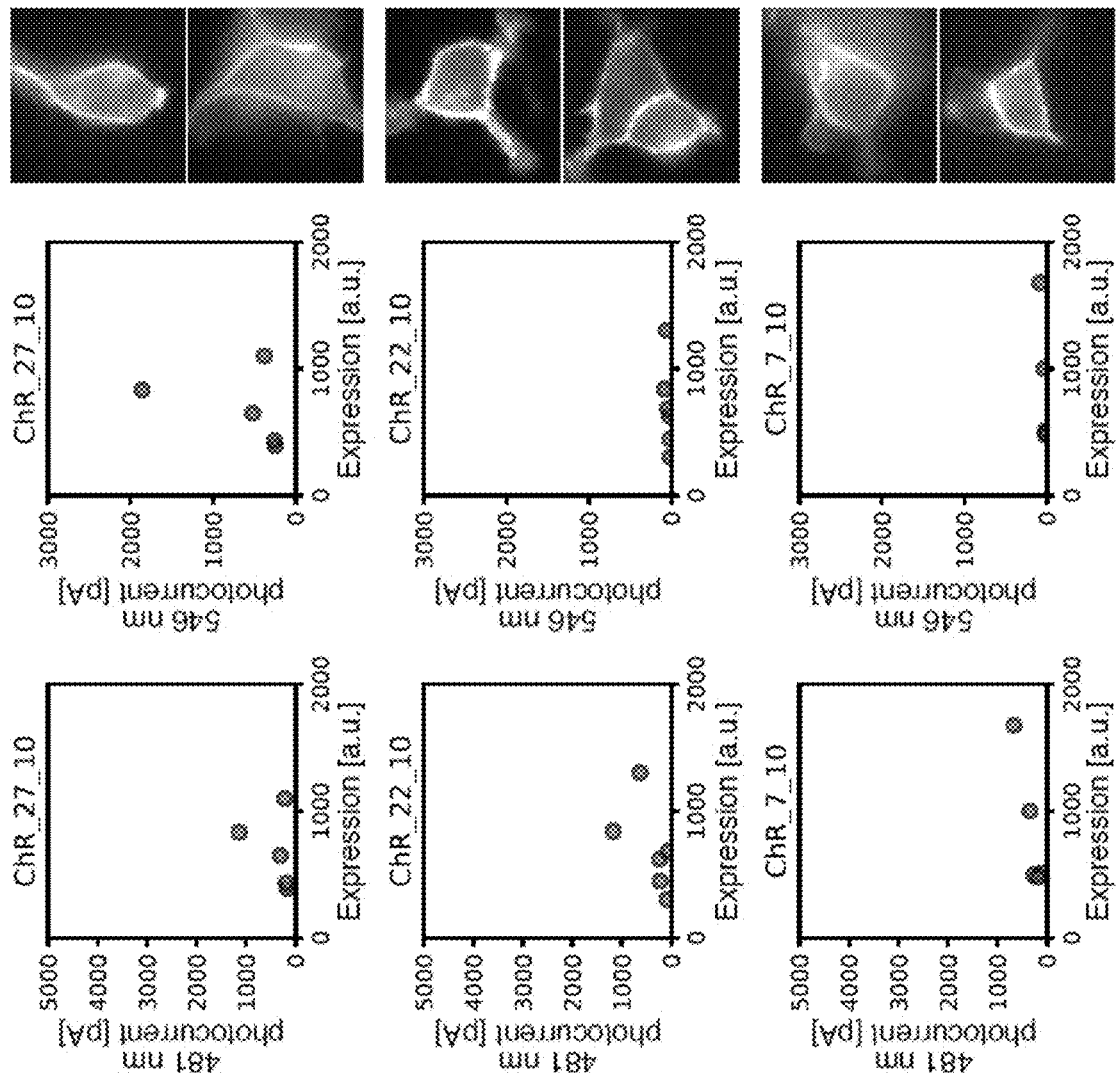
Figure 10J:
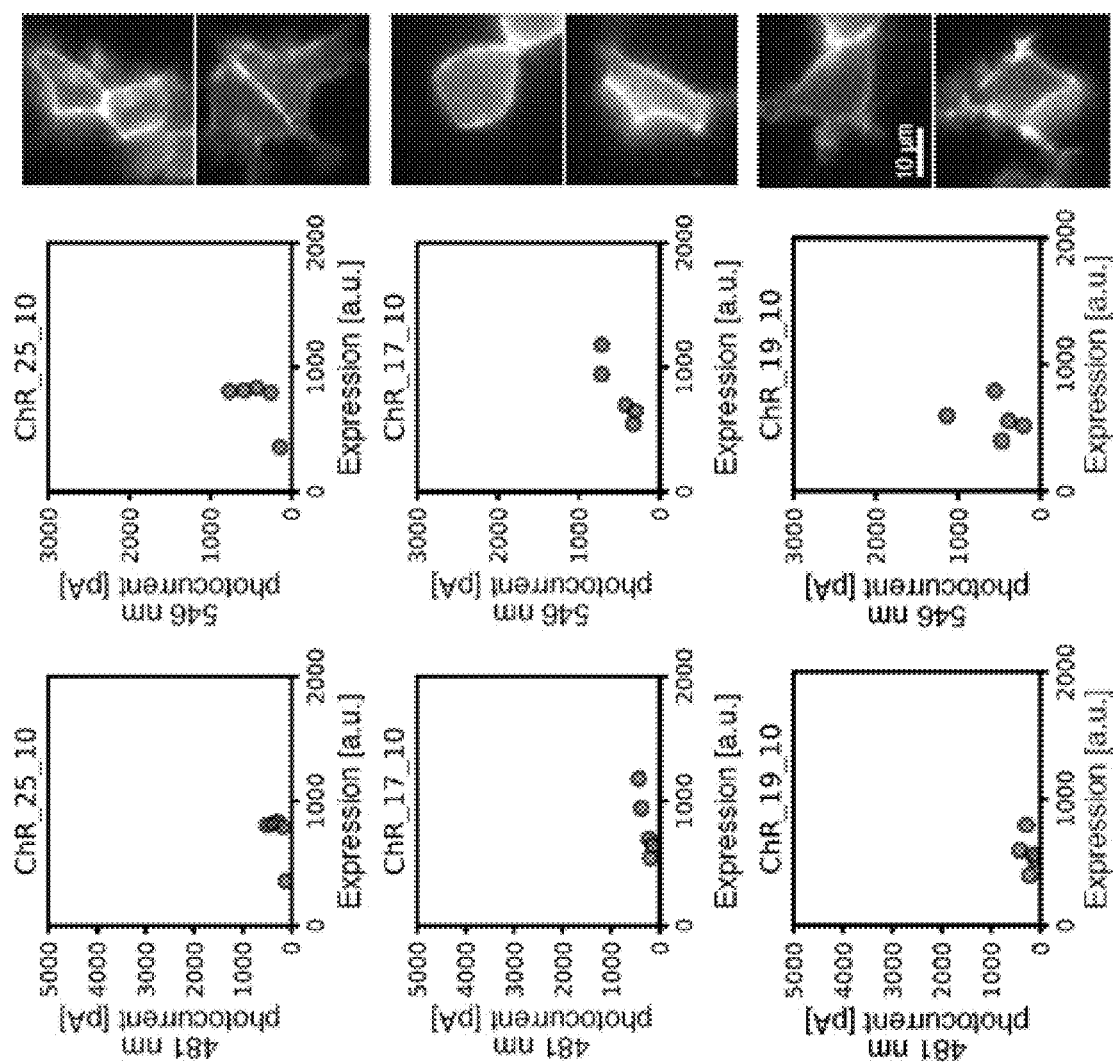
Figure 10K:
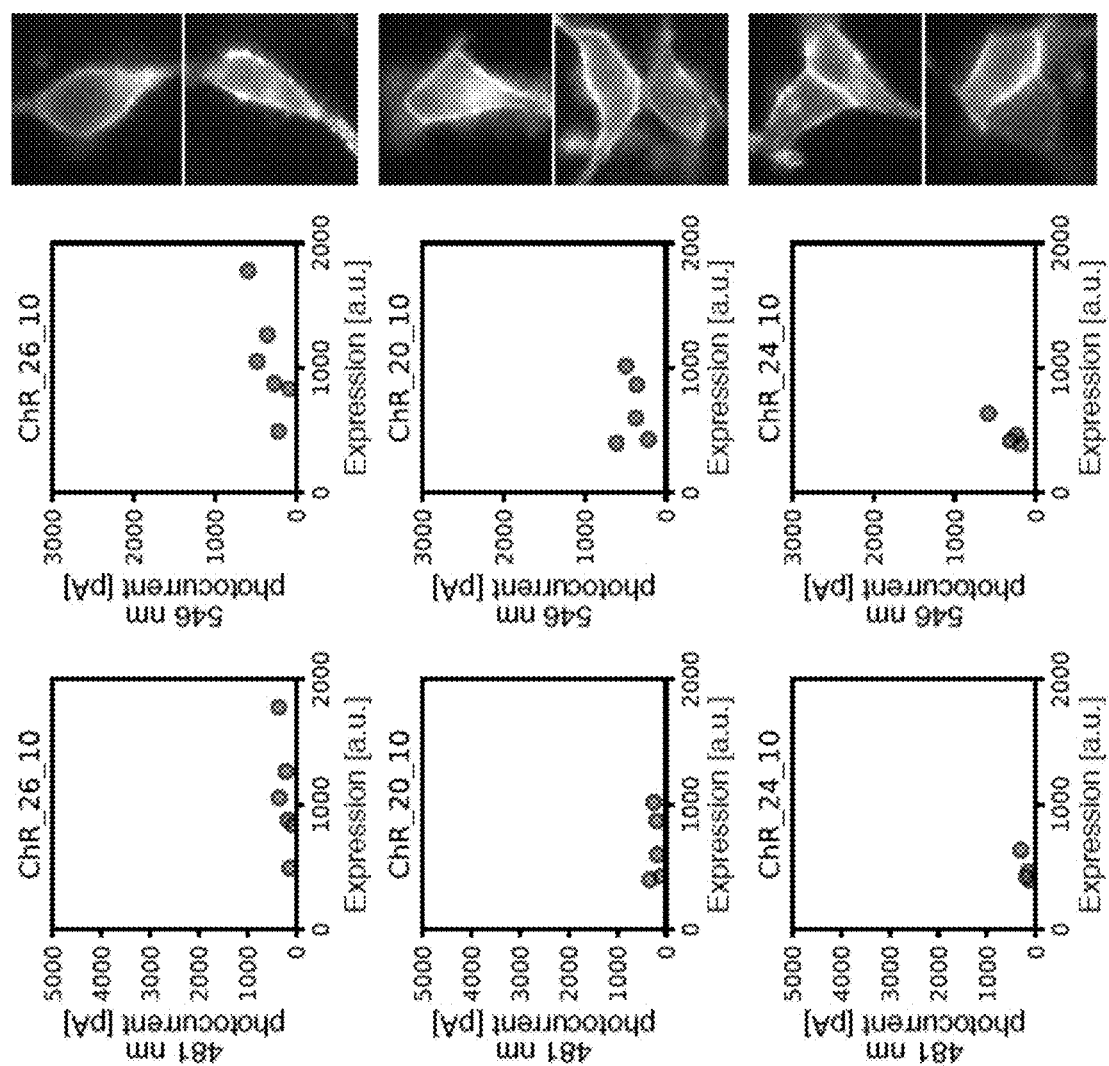
Figure 10L:
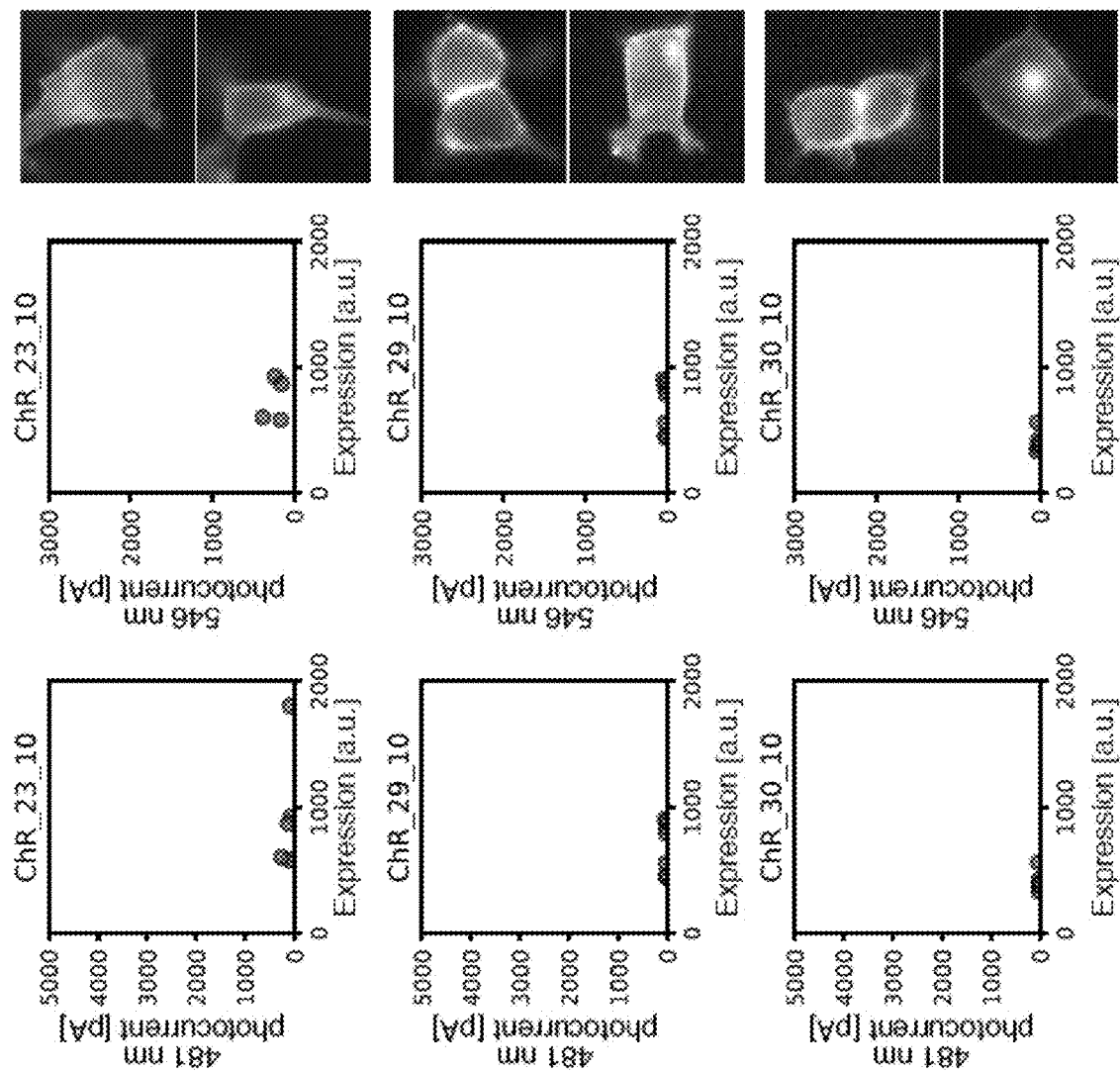
Figure 11A:
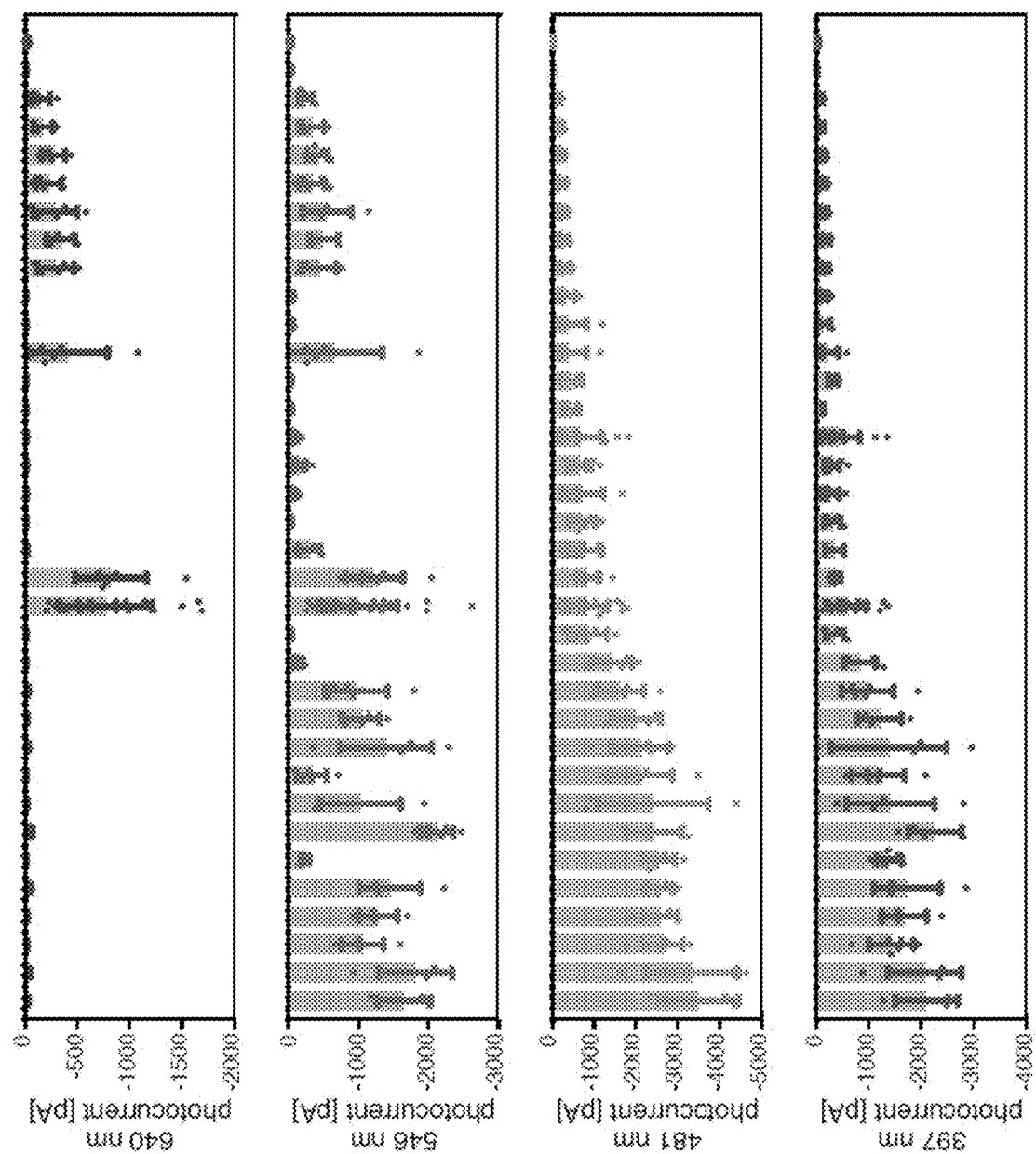

Patch-clamp recordings were done with short light pulses to measure photocurrents. Light pulse duration, wavelength, and power were varied depending on the experiment as described herein. Light pulses were generated using a Lumencor SPECTRAX light engine. The illumination/output spectra for each color were measured (FIGS. 9A-B). To evaluate normalized green photocurrent, photocurrent strength was measured at three wavelengths (peak±half width at half maximum): (red) 640±3 nm, (green) 546±16 nm, and (cyan) 481±3 nm with a 0.5 s light pulse. Light intensity was matched for these measurements, with 481 nm light at 2.3 mW $mm^2$, 546 nm light at 2.8 mW $mm^2$, and 640 nm light at 2.2 mW $mm^{-2}$. For full spectra measurements depicted in FIG. 2E, photocurrents were measured at seven different wavelengths (peak±half width half maximum): (red) 640±3 nm, (yellow) 567±13 nm, (green) 546±16 nm, (teal) 523±6 nm, (cyan) 481±3 nm LED, (blue) 439±8 nm LED, and (violet) 397±3 nm with a 0.5 s light pulse for each color. Light intensity is matched across wavelengths at 1.3 mW $mm^2$.

Imaging of ChR variants expression in HEK cells was performed using an Andor Neo 5.5 sCMOS camera and Micro-Manager Open Source Microscopy Software. Imaging of ChR expression in neuronal cultures and in brain slices was performed using a Zeiss LSM 880 confocal microscope and Zen software.

Electrophysiology Data Analysis

Electrophysiology data were analyzed using Clampfit 10.7 from Molecular Devices, LLC (San Jose, CA) and custom data-processing scripts written using open-source packages in the Python programming language to perform baseline adjustments, find the peak and steady state inward currents, perform monoexponential fits of photocurrent decay for off-kinetic properties, and quantify spike fidelity. Only neurons with an uncompensated series resistance between 5 and 25 MΩ, $R_m$>90 MΩ, and holding current >−150 pA (holding at −60 mV) were included in data analysis (FIGS. 14A-B). The photocurrent amplitude was not adjusted for expression level since both expression and conductance contribute to the in vivo utility of the tool. Comparisons of expression with photocurrent strength for all ChR variants tested are included in FIGS. 10A-L and 11. As metrics of photocurrent strength, peak and steady-state photocurrent were used (FIG. 1A). As a metric for the ChR activation spectrum, the normalized current strength induced by exposure to green light (546 nm) was used (FIG. 1A). Two parameters were used to characterize ChR off-kinetics: the time to reach 50% of the light-activated current and the photocurrent decay rate, $\tau_{off}$ (FIG. 1A).

AAV Production and Purification

Production of recombinant AAV-PHP.eB packaging pAAV-hSyn-X-TS-eYFP-WPRE, pAAV-CAG-DIO[X-TS-eYFP]-WPRE, and pAAV-CaMKIIa-X-TS-eYFP-WPRE (X=ChR2(H134R), CoChR, ChRger1, ChRger2, and ChRger3) was done following the methods described in Deverman et al. (Nat Biotechnol 2016, 34:204-209) and Challis et al. (Nat Protoc. 2019, 14(2):379-414). Briefly, triple transfection of HEK293T cells (ATCC) was performed using polyethylenimine (PEI). Viral particles were harvested from the media and cells. Virus was then purified over iodixanol (Optiprep, Sigma; D1556) step gradients (15%, 25%, 40% and 60%). Viruses were concentrated and formulated in phosphate buffered saline (PBS). Virus titers were determined by measuring the number of DNase I-resistant viral genomes using qPCR with linearized genome plasmid as a standard.

Animals

Dat-Cre mice (006660) and C57Bl/6J mice (000664) were purchased from Jackson Laboratory (Bar Harbor, ME).

Intravenous Injections, Stereotactic Injections, and Cannula Implantation

Intravenous administration of rAAV vectors was performed by injecting the virus into the retro-orbital sinus at viral titers indicated in the text. There were no observed health issues with animals after systemic injection of virus at the titers presented in the paper. Mice remain healthy >6 months after systemic delivery of ChR2 and ChRgers. With slice electrophysiology, there was no observed indication of poor cell health due to viral-mediated expression, which was quantified by measuring the membrane resistance [$R_m$], leak current [holding at −60 mV], and resting membrane potential (FIGS. 14A-B). Local expression in the prefrontal cortex (PFC) was achieved by direct stereotactic injection of 1 µl of purified AAV vectors at $5\times10^{12}$ vg $ml^{-1}$ targeting the following coordinates: anterior-posterior (AP), −1.7; mediaderal (ML), +/−0.5; and dorsal-ventral (DV), −2.2. For stimulation of the VTA, 300 µm outer diameter mono fiber-optic cannulae (Doric Lenses, MFC_300/330-0.37_6mm_ZF1.25_FLT) were stereotaxically implanted 200 µm above the VTA bilaterally targeted to the following coordinates: AP, −3.44 mm; ML, +/−0.48 mm; DV, 4.4 mm. For stimulation of the right secondary motor cortex (M2), 3 mm long, 400 µm mono fiber-optic cannulae (Doric Lenses, MFC_400/430-0.48_3mm_ZF1.25_FLT) were surgically secured to the surface of the skull above M2 (unilaterally) targeted to the following coordinates: AP, 1 mm; ML, 0.5 mm. The skull was thinned ~40-50% with a standard drill to create a level surface for the fiber-skull interface. Light was delivered from either a 447 nm or 671 nm laser (Changchun New Industries [CNI] Model with PSU-H-LED) via mono fiber-optic patch cable(s) (Doric Lenses, MFP_400/430/1100-0.48_2m_FC-ZF1.25) coupled to the fiber-optic cannula(e). Fiber-optic cannulae were secured to the skull with Metabond (Parkel, SKU 5396) and dental cement.

Analysis of behavioral experiments was performed using the open-source MATLAB program OptiMouse[43] to track mouse nose, body, and tail position while the mouse was running on the treadmill. Optogenetic intracranial self-stimulation was performed using a mouse modular test chamber (Lafayette Instruments, Model 80015NS) outfitted with an IR nose port (Model 80116TM).

Gaussian Process Modeling

Both the GP regression and classification modeling methods applied in this paper are based on work detailed in ref 8 and 23. For modeling, all sequences were aligned using MUltiple Sequence Comparison by Log-Expectation (MUSCLE) (ebi.ac.uk/Tools/msa/muscle/). For modeling, aligned sequences were truncated to match the length of the C1C2 sequence, eliminating N- and C-terminal fragments with poor alignment quality due to high sequence diversity. Structural encodings (i.e., the contact map) use the C1C2 crystal structure (3UG9.pdb) and assume that ChR chimeras share the contact architecture observed in the C1C2 crystal structure. Models built using structural encodings built from the ChR2 structure (6EID.pdb) and the C1Chrimson structure (5ZIH.pdb) performed as well as models using the C1C2 structure (FIGS. 5C-D). The models are robust to differences in contact maps because they use both sequence and structural information, which is somewhat redundant.

For a given ChR, the contact map is simply a list of contacting amino acids with their positions. For example, a contact between alanine at position 134 and methionine at position 1 of the amino acid sequence would be encoded by [('A134'), ('M1')]. Both sequence and structural information were one-hot encoded. Regression models for ChR properties were trained to predict the logarithm of the measured properties. All training data was normalized to have mean zero and standard deviation one.

Gaussian process regression and classification models require kernel functions that measure the similarity between protein sequences. Learning involves optimizing the form of the kernel and its hyperparameters (Table 2). The Matérn kernel was found to be optimal for all ChR properties (Table 1).

For classification model training, all 102 functionally characterized ChR variants from the recombination libraries (Table 2) were used as well as data from 61 sequence variants published by others (Dataset 1). The model was then updated with data collected from the 22 additional ChR recombination variants with high sequence diversity (~70 mutations from the closest parent) and predicted to be functional (FIG. 1D). For training the regression models, all 102 functionally characterized training sequences (Dataset 2) were initially used and then the models were updated with data collected from the 22 additional ChR variants (FIG. 1D).

GP Regression

In regression, the goal is to infer the value of an unknown function $f(x)$ at a novel point $x_*$ given observations y at inputs X. Assuming that the observations are subject to independent and identically distributed Gaussian noise with variance $\sigma_n^2$, the posterior distribution of $f_*=f(x_*)$ for Gaussian process regression is Gaussian with mean $$\bar{f}_* = k_*^T(K+\sigma_n^2 I)^{-1}y \qquad (1)$$

and variance $$v_* = k(x_*,x_*) - k_*^T(K+\sigma_n^2 I)^{-1}k_* \qquad (2)$$

Where K is the symmetric, square covariance matrix for the training set: $K_{ij}=k(x_i, x_j)$ for $x_i$ and $x_j$ in the training set. $k_*$ is the vector of covariances between the novel input and each input in the training set, and $k_{*i}=k(x_*, x_i)$. The hyperparameters in the kernel functions and the noise hyperparameter $\sigma_n$ were determined by maximizing the log marginal likelihood:

$$\log p(y\mid X) = -\frac{1}{2}y^T(K+\sigma_n^2 I)^{-1}y - \frac{1}{2}\log|K+\sigma_n^2 I| - \frac{n}{2}\log 2\pi \qquad (3)$$

where n is the dimensionality of the inputs. Regression was implemented using open-source packages in the SciPy ecosystem.

GP Classification

In binary classification, instead of continuous outputs y, the outputs are class labels $y_i \in \{+1, -1\}$, and the goal is to use the training data to make probabilistic predictions $\pi(x_*)$ $=p(y_*=+1|x_*)$. Laplace's method was used to approximate the posterior distribution. Hyperparameters in the kernels are found by maximizing the marginal likelihood. Classification was implemented using open-source packages in the SciPy ecosystem. The binary classification model was trained to predict if a ChR sequence is or is not functional. A ChR sequence was considered to be functional if its photocurrents were >100 pA upon light exposure, a threshold set as an approximate lower bound for current necessary for neuronal activation.

GP Kernels for Modeling Proteins

Gaussian process regression and classification models require kernel functions that measure the similarity between protein sequences. A protein sequence s of length L is defined by the amino acid present at each location. This can be encoded as a binary feature vector $x_{se}$ that indicates the presence or absence of each amino acid at each position resulting in a vector of length 20L (for 20 possible amino acids). Likewise, the protein's structure can be represented as a residue-residue contact map. The contact map can be encoded as a binary feature vector $x_{st}$ that indicates the presence or absence of each possible contacting pair. Both the sequence and structure feature vectors were used by concatenating them to form a sequence-structure feature vector.

Three types of kernel functions $k(s_i, s_j)$ were considered: polynomial kernels, squared exponential kernels, and Matérn kernels. These different forms represent possible functions for the protein's fitness landscape. The polynomial kernel is defined as:

$$k(s,s') = (\sigma_0^2 + \sigma_p^2 x^T x')^d \quad (4)$$

where $\sigma_0$ and $\sigma_p$ are hyperparameters. Polynomial kernels were considered with d=3. The squared exponential kernel is defined as:

$$k(s, s') = \sigma_p^2 \exp\left(-\frac{\|x - x'\|_2^2}{l}\right) \quad (5)$$

where l and $\sigma_p$ are also hyperparameters and $|\cdot|_2$ is the L2 norm. Finally, the Matérn kernel with v=5/2 is defined as:

$$k(s, s') = \left(1 + \frac{\sqrt{5\|x - x'\|_2^2}}{l} + \frac{5\|x - x'\|_2^2}{3l^2}\right)\exp\left(-\frac{\sqrt{5\|x - x'\|_2^2}}{l}\right) \quad (6)$$

Where l is once again a hyperparameter.

L1 Regression Feature Identification and Weighting

L1 regression was used to identify residues and contacts in the ChR structure most important for each ChR functional property of interest. First, residues and contacts that covary were identified using the concatenated sequence and structure binary feature vector for each of the training set ChR variants. Each set of covarying residues and contacts was combined into a single feature. L1 linear regression was used to select the features that contribute most to each ChR functional property of interest. The level of regularization was chosen by maximizing the log marginal likelihood of the Gaussian process regression model trained on the features selected at that level of regularization. Bayesian ridge regression was then performed on the selected features using the default settings in scikit-learn. Residues and contacts with the largest absolute Bayesian ridge linear regression weights were plotted onto the C1C2 structure (FIGS. 8A-D). For feature identification and weighting, models were trained on both the training set and also the test set of 28 ChR sequences predicted to have useful combinations of diverse properties.

Statistical Analysis

Plotting and statistical analysis were done in Python 2.7 and 3.6 and GraphPad Prism 7.01. For statistical comparisons, a D'Agostino & Pearson normality test was first performed. If the p-value of a D'Agostino & Pearson normality test was <0.05, the non-parametric Kruskal-Wallis test with Dunn's multiple comparisons post hoc test was used. If the data passed the normality test, a one-way ANOVA was used.

Dataset 1 (shown in Tables 3 and 4). ChR sequence and photocurrent data from published sources including 19 natural ChR variants, 14 point-mutant ChR variants, and 28 recombination variants from various recombination libraries. The source of the photocurrent data is included ('Reference'). When possible, references were used with side-by-side measurements of multiple ChRs. For modeling, all sequences were aligned and truncated to match the length of the C1C2 sequence. The truncated and aligned sequences are included ('Aligned amino acid sequence') as well as the full-length sequence ('Amino acid sequence').

TABLE 3

ChR sequence and photocurrent data from published sources including 19 natural ChR variants, 14 point-mutant ChR variants, and 28 recombination variants from various recombination libraries.

| SEQ ID NO. | ChR name | Photo-current (nA) | Reference | Accession codes | Amino acid sequence |
|---|---|---|---|---|---|
| 200 | PsChR1 | 0.1 | Independent optical excitation of distinct neural populations | KF992074 | MTTISEVCGVWALDNPECIEVSGTNDNVKMAQLCFCMVCVCQLLFMASQYPKVG WEAIYLPSCECFLYGLASSGNGFIQLYDGRLIPWARYAAWICTCPSILLQINTI HKCKISHFNLNTFIVQADLIMNIMGVTGALTTNIAFKWIYFAIGCILFIFIVLV VYDIMTSAAKEWKAKGDSKGNLVSTRLILLRWIPIVSWCVYPLLWILSPQATCA VSEDVISVAHFICDAFAKNMPGFIMWRTLWRDLDGHWDISRHYPQSSYAKDGKE EEQMTAMSQTDDTEKPHSSQG |
| 201 | PsChR2 | 0.12 | Independent optical excitation of distinct neural populations | KF992056 | MTMLEHLEGTMDGWYAENDLGQGAIIAHWVTFFPHMITTFYLGVSFHSKGPGG KQPYFAGYHEENNIGIFVNLFAAISYFGKVVSDTHGHNYQNVGPFIIGLGNYRY ADYMLTCPLLVMDLLFQLRAPYKITCAMLIFAVLMIGAVTNFYPGDDMKGPAVA WFCFGCFWYLIAYIFMAHIVSKQYGRLDYLAHGTKAEGALFSLKLAIITFFAIW VAFPIVWLLSVGTGVLSNEAAEICHCICDVVAKSVYGFALANFREQYDRELYGL LNSIGLDGEDVVQQLEKEMQTNHHKKKSINSPAVG |
| 202 | MyChR1 | 0 | Independent optical excitation of distinct neural populations | JF922293 | MSPPTSPTPDTGHDTPDTGHGAVEICFAPCEEDCVTIRYFVENDFEGCI PGHFDQYSSHGSLHDIVKAALYICMVISILQILFYGFQWWRKTCGWEVWFVACI ETSIYIIAITSEADSPFTLYLTNGQISPQLRYMEWLMTCPVILIALSNITGMAE EYNKRTMTLLTSDVCCIVLGMMSAASKPRLKGILYAVGWAFGAWTYWTALQVYR DAHKAVPKPLAWYVRAMGVYFFTSWLTPPGWFLLGPEGLEVTGTVSTLMHACS DLISKNLWGFMDWHLRVLVARHHRKLFKAEEEHALKKGQTLEPGMPRSTSFVRG LGDDVEI |
| 203 | SdChR | 1.35 | Independent optical excitation of distinct neural populations | KF992072 | MGGAPAPDAHSAPPGNDSAGGSEYHAPAGYQVNPPYHPVHGYEEQCSSIYIYYG ALWEQETARGFQWFVFLSALFLAFYGWHAYKASVGWEEVYYVCSVELIKVILEI YFEFTSPAMLFLYGGNITPWLRYAEWLLTCPVILIHLSNITGLSEEYNKRTMAL LVSDLGTICMGVTAALATGWVKWLFYCIGLVYGTQTFYNAGIIYVESYYIMPAG GCKKLVLAMTAVYYSSWLMPPGLPIFGPEGMHTLSVAGSTIGHTIADLLSKNIW GLLGHFLRIKIHEHIIMYGDIRRPVSSQFLGRKVDVLAFVTEEDKV |
| 204 | TcChR | 0.24 | Independent optical excitation of distinct neural populations | KF992057 | MGWKINPLYSDEVAILEICKENEMVFGPLMEQKLARALQMFTVILSAIFPLAYYV YSTLRATCGWEELYVCTVEFTKVVVEVYLEYVPPPMIYQMNGQHTPWLRYMEWL LTCPVILIHLSNITGLNDEYSGRTMSLLTSDLGGIAFAVLSALAVGWQKGLYFG IGCIYGASTFYHAACIYIESYHTMPAGKCKRLVVAMCAVFFTSWFMFPPALFLAG PECFDGLTWSGSTIAHTVADLLSKNIWGLIGHFLRVGIHEHILVHGDVRRPIEV TIFGKETSLNCFVENDDEEDDV |
| 205 | TsChR | 0.16 | Independent optical excitation of distinct neural populations | KF992089 | MFAINPEYMNETVLLDECTPIYLDIGPLMEQVVARVTQWFGVILSLVFLIYYIW NTYKATCGWEELYVCTVEFCKIIIELYFEYTPPAMIFQTNGQVTPWLRYAEWLL TCPVILIHLSNITGLNDDYSGRTMSLITSDLGGICMAVTAALSKGWLKALFFVI GCGYGASTFYNAACIYIESYYTMPQGICRRLVLWMAGVFFTSWFMPPGLFLAGP EGTQALSWAGTTIGHTVADLLSKNAWGMIGHFLRVEIHKHIIHGDVRRPVTVK ALGRQVSVNCFVDKEEEEDERI |

TABLE 3-continued

ChR sequence and photocurrent data from published sources including 19 natural ChR variants, 14 point-mutant ChR variants, and 28 recombination variants from various recombination libraries.

| SEQ ID NO. | ChR name | Photo-current (nA) | Reference | Accession codes | Amino acid sequence |
|---|---|---|---|---|---|
| 206 | CbChR1 | 0 | Independent optical excitation of distinct neural populations | KF992062 | MAAGLEGLVSSASRGLHASIPENPYHSDGHHLPCGLTPFGCMDDFWCNPEYGMS YAGYTYCFSELAFGKLVMVPEADAGWLHSHGTQAEFVAATACQYTALSLALLL SFYAYSAWKATCGWEEGYVCCVELFVTLEISNEFNSPATLYLSTGNYCYFLRY GEWLLSCPVILIHLSNLSGLKNDYSMRTMRLLVSCIGMLITGMAGGLGVGWVKM TLYFVSCAYSAQTYLQAAKCYVEVYATVPKGYCRTVVKLMAYAFFTAWGAYPIL WAIGPEGLKYISGYSNTIAHTFCDILAKEIWTFLGHHLRIKIHEHILIHGDIRK KVQVRVAGELMNVEELMEEEGEDTV |
| 207 | Chrimson | 0.67 | Independent optical excitation of distinct neural populations | KF992060 | MAELISSATRSLFAAGGINPWPNPYHHEDMGCGGMTPTGECFSTEWWCDPSYGL SDAGYGYCFVEATGGYLVVGVEKKQAWLHSRGTPGEKIGAQVCQWIAFSIAIAL LTFYGFSAWKATCGWEEVYCCVEVLFVTLEIFKEFSSPATVVLSTGNHAYCLR YFEWLLSCPVILIKLSNLSGLKNDYSKRTMGLIVSCVGMIVFGMAAGLATDWLK WLLYIVSCIYGGYMYFQAAKCYVEANHSVPKGHCRMVVKLMAYAYFASWGSYPI LWAVGPEGLLKLSPYANSIGHSICDIIAKEFWTFLAHHLRIKIHEHILIHGDIR KTTKMEIGGEEVEEFVEEEDEDTV |
| 208 | Chronos | 1.22 | Independent optical excitation of distinct neural populations | KF992040 | METAATMTHAFISAVPSAEATIRGLLSAAAVVTPAADAHGETSNATTAGADHGC FPHINHGTELQHKIAVGLQMFTVIVAIVQLIFYGWHSFKATTGWEEVVVCVIEL VKCPIELFVEHEVDSPATVVYQTNGGAVIWLRYSMWLLTCPVILIHLSNLTGLHEEY SKRTMTILVTDIGNIVWGITAAFTKGPLKILFFMIGLFYGVTCFFQIAKVYIES YHTLPKGVCRKICKIMAYVFFCSWLMPFPVMFIAGHEGLGLITPYTSGIGHLILD LISKNTWGFLGHHLRVKIHEHILIHGDIRKTTTINVAGENMEITFVDEEEEGG V |
| 209 | HdChR | 0.14 | Independent optical excitation of distinct neural populations | KF992059 | MSVNLSLWEHGEDAGYGHWYQGTPNGTLVCSHEDNIAWLKNKGTDEEMLGANIC MWMAFAACLLCLSFYAYSTWRATCGWEEVYVCLVEMVKVMIEVFHENDSPATLY LSTGNFIMWIRYGEWLLSCPVILIHLSNITGLQDQYSKRTMQLLVSDLGTITMG VTAALCGNYVKWIFFILGLCYGVNTYFHAAKVIESYHIVPKGVCRVCVRVMAW CFFGAWTCYPLLFVFGPEGLGVLSYNASAIGHTIIDIFSKQVWGFVGHYLRIKI HEHIVIHGNIVKPTKVKVAGMEIDAEEMVEKDEEGAI |
| 210 | BsChR2 | 0.68 | Independent optical excitation of distinct neural populations | KF992034 | MEAYAYPELLGSAGRSLFAATVPENISESTWVDAGYQHPWTQRQNETVVCEHYT HASWLISHGTKAEKTAMIACQWPAFGSAVLILLYAWHTWKATSGWEEVYVCCV ELVKVLFEIYHEIHHPCTLYLVTGNFILMLRYGEWLLTCPVILIHLSNITGLKN DYNKRTMQLLVSDIGCVVWGVTAALCYDYKKWIPFCLGLVYGCNTYFHAAKVYI EGYHTVPKGECRIIVKVMAGVFYCSWTLPFLLFLLGPEGTGAFSAYGSTIAHTV ADVLSKQLWGLLGHHLRVKIHEHIIHGNLTVSKKVKVAGVEVETQEMVDSTEE DAV |
| 211 | CnChR2 | 0.83 | Independent optical excitation of distinct neural populations | KF992073 | MEPVLGLASTAVRELTAGGSGNPYESYKPPEDPCALTPFGCLTNFWCDPQFGLA DAKDYCVVKAAYGELAIVETSRLPWLYSHGSDAEHQGALAMQWMAFALCIICL VFYAYHSWKATTGWEEVYVCVVELVKVLLEIYKEFESPASIYLPTANAALWLRY GEWLLTCPVILIHLSNITGLKDDYNKRTMQLLVSDIGCVVWGITAAFSVGWLKW VFFVLGELGHMSAYMSTALHGVADMLSKQIWGLLGHHLRVKIFEHILIHGDIRK TTTMQVGGQMVQVEMVDEDEDTI |

TABLE 3-continued

ChR sequence and photocurrent data from published sources including 19 natural ChR variants, 14 point-mutant ChR variants, and 28 recombination variants from various recombination libraries.

| SEQ ID NO. | ChR name | Photo-current (nA) | Reference | Accession codes | Amino acid sequence |
|---|---|---|---|---|---|
| 212 | CsChR | 1.07 | Independent optical excitation of distinct neural populations | KF992078 | MSRLVAASWLLALLLCGITSTTTASSAPAASSTDGTAAAAVSHYAMNGFDELAK GAVVPEDHFVCGPADKCYCSAWLHSHGSKEEKIAFTVMQMIVFAVCIISLLFYA YQTWRATCGWEEVVTIIELVHVCFGLWHEVDSPCTLYLSTGNMVLWLRYAEWL LTCPVILIHLSNLTGMKNDYNKRTMALLVSDVGCIVWGTAALSTDFVKIIFFF LGLLYGFYTFYAAAKIYIEAYHTVPKGICRQLVRLQAYDFFFTWSMFPILFMVG PEGPGKITAYSSGIAHEVCDLLSKNLWGLMGHFIRVKIHEHILVHGNITKKTKV NVAGDMVELDTYVDQDEEHDEG |
| 213 | AgChR | 0 | Independent optical excitation of distinct neural populations | KF992038 | MGTPDPLLSSIPGTDIGLGDWTEYSNYYFLNATNSTHKWVAGPEDDCFCKAWTF NRGSDEESVAAFAIAWVFSLSVLQLLYYAYAQWRSTCGWEEVYVGIIELTHIC IAIFREFDSPAMLYLSTGNFVVWARYASWLLSCPVILIHLSNLTGMKGNYSKRT MALLVSDIGTIVWGSTSAMSPHNHVKIIFFFLGLVFGLFTFYAAAKVLEAYHT VPKGKCRNIVRFMAWTYYVTWALPFILFILGPEGFGHITYYGSSIGHYVLEIFS KNLWSGTGHYLRLKIHEHIILHGNLTKKTKINIAGEPLEVEEYVEADDTDEGV |
| 214 | NsChR | 0.03 | Independent optical excitation of distinct neural populations | KF992054 | MADFWQGAGNGPSAMVSHYPNGSVLLESSGSCYCEDWYTSRGNHVEHSLSNA CDWFAFAISVIFLVYYAWAAFNSSVGWEEIYVCTVELIKVSIDQFLSSNSPCTL YLSTGNRVLWIRYGEWLLTCPVILIHLSNVTGLKDNYSKRTMALLVSDIGTIVF GVTSAMCTGYPKVIFFILGCCYGANTFFNAAKVLEAHHTLPKGSCRTLIRLMA YTYYASWGMFPILFVLGPESFGHMNMYQSNIAHTVIDLMSKNIWGMLGHFLRHK IREHILIHGDLRTTTTVNVAGEEMQVETMVAAEDADETV |
| 215 | CoChR | 3.25 | Independent optical excitation of distinct neural populations | KF992041 | MLGNGSAIVPIDQCFCLAWTDSLGSDTEQLVANILQWFAFGFSILILMFYAYQT WRATCGWEEVYVCCVELTKVIIERFHEFDDPSMLYLANGHRVQMLRYAEWLLTC PVILIHLSNLTGLKDDYSKRTMRLLVSDVGTIVWGATSAMSTGYVKVIFFVLGC IYGANTFFHAAKVYIESYHVVPKGRPRTVVRIMAWLFFLSWGMPPVLFVVGPEG FDAISVYGSTIGHTIIDLMSKNCWGLLGHYLRVLIHQHIIIYGDIRKKTKINVA GEEMEVETMVDQEDEETV |
| 216 | V2V1-43 | 0 | Color-tuned ChRs for multiwavelength optogenetics | — | MDHPVARSLIGSSYTNLNNGSIVIPSDACFCMKWLKSKGSPVALKMANALQWAA FALSVIIILYYAYATWRTTCGWEEVYVCCVELTKVIEFFHEFDEPGMLYLANG NRVLWLRYGEWLLTCPVILIHLSNLTGLKDDYNKRTMRLLVSDVGTIVWGATSA MCTGWTKILFFLISLSYGMYTYFHAAKVYIEAFHTVPKGICRELVRVMAWTFFV AWGMFPVLFLLGTEGFGHISPYGSAIGHSILDLIAKNMWGVLGNYLRVKIHEHI LLYGDIRKKQKITIAGQEMEVETLVAEEED |
| 217 | V2V1-25 | 0.8 | Color-tuned ChRs for multiwavelength optogenetics | — | MDHPVARSLIGSSYTNLNNGSIVIPSDACFCMKWLKSKGSPVALKMANALQWAA FALSVIIILYYAYATWRTTCGWEEVYVCCVELTKVIEFFHEFDEPGMLYLANG NRVLMLRYGEWLLTCPVILIHLSNLTGLKDDYSKRTMGLLVSDVGCIVWGATSA MCTGWTKILFFLISLSYGMTYFHAAKVYIEAFHTVPKGICRELVRVMAWTFFV AWGMFPVLFLLGTEGFGHISPYGSAIGHSILDLIAKNMWGVLGNYLRVKIHEHI LLYGDIRKKQKITIAGQEMEVETLVAEEED |

TABLE 3-continued

ChR sequence and photocurrent data from published sources including 19 natural ChR variants, 14 point-mutant ChR variants, and 28 recombination variants from various recombination libraries.

| SEQ ID NO. | ChR name | Photo-current (nA) | Reference | Accession codes | Amino acid sequence |
|---|---|---|---|---|---|
| 218 | V2V1-52 | 0 | Color-tuned ChRs for multiwavelength optogenetics | — | MDHPVARSLIGSSYTNLNNGSIVIPSDACFCMKWLKSKGSPVALKMANALQWAA FALSVIILIYYAYATWRTTCGWEEVYCCVELTKVIEFFHEFDEPGMLYLANG NRVLWLRYGEWLLTCPVLLIHLSNLTGLKDDYSKRTMGLLVSDVGCIVWGATSA MCTGWTKILFFLISLSYGMYTYFHAAKVYIEAFHTVPKGICRELVRVMAWTFFV AWGMFPVLFLLGTEGFGHISPYGSAIGHSILDLIAKNMWGVLGNYLRVKIHEHI LLYGDIRKKQKITIAGQEMEVETLVAEEED |
| 219 | V2V1-61 | 0.2 | Color-tuned ChRs for multiwavelength optogenetics. | — | MDHPVARSLIGSSYTNLNNGSIVIPSDACFCMKWLKSKGSPVALKMANALQWAA FALSVIILIYYAYATWRTTCGWEEVYCCVELTKVIEFFHEFDEPGMLYLANG NRVLWLRYGEWLLTCPVLIIHLSNLTGLKDDYNKRTMRLLVSDVGTIVWGATAA MSTGYIKVIFFLLGCMYGANTFFHAAKVYIESYHTVPKGGLCRQLVRAMAWLFFV SWGMFPVLFLLGPEGFGHLSVYGSTIGHSILDLIAKNMWGVLGNYLRVKIHEHI LLYGDIRKKQKITIAGQEMEVETLVAEEED |
| 220 | V1V2-133 | 0.3 | Color-tuned ChRs for multiwavelength optogenetics | — | MDYPVARSLIVRYPTDLGNGTVCMPRGQCYCEGWLRSRGTSIEKTIAITLQWVV FALSVACLGWYAYQAWRATCGWEEVYVCCVELTKVIEFFHEFDSPATLWLSSG NRVLWLRYGEWLLTCPVILIHLSNLTGLKDDYNKRTMRLLVSDVGTIVWGATAA MSTGYIKVIFFLLGCMYGANTFFHAAKVYIEAFHTVPKGICRELVRVMAWTFFV AWGMFPVLFLLGTEGFGHISPYGSAIGHSILDLIAKNMWGVLGNYLRVKIHEHI LLYGDIRKKQKITIAGQEMEVETLVAEEED |
| 221 | VChR1 | 0.23 | Independent optical excitation of distinct neural populations | EU622855 | MDYPVARSLIVRYPTDLGNGTVCMPRGQCYCEGWLRSRGTSIEKTIAITLQWVV FALSVACLGWYAYQAWRATCGWEEVYVALIEMMKSIIEAFHEFDSPATLWLSSG NGVVWMRYGEWLLTCPVILIHLSNLTGLKDDYSKRTMGLLVSDVGCIVWGATSA MCTGWTKILFFLISLSYGMYTYFHAAKVYIEAFHTVPKGICRELVRVMAWTFFV AWGMFPVLFLLGTEGFGHISPYGSAIGHSILDLIAKNMWGVLGNYLRVKIHEHI LLYGDIRKKQKITIAGQEMEVETLVAEEED |
| 222 | V1V2-223 | 0.5 | Color-tuned ChRs for multiwavelength optogenetics | — | MDYPVARSLIVRYPTDLGNGTVCMPRGQCYCEGWLRSRGTSIEKTIAITLQWVV FALSVACLGWYAYQAWRATCGWEEVYVALIEMMKSIIEAFHEFDSPAMLYLANG NRVLWLRYGEWLLTCPVILIHLSNLTGLKDDYNKRTMRLLVSDVGTIVWGATAA MSTGYIKILFFLISLSYGMTYFHAAKVYIEAFHTVPKGICRELVRVMAWTFFV AWGMFPVLFLLGTEGFGHISPYGSAIGHSILDLIAKNMWGVLGNYLRVKIHEHI LLYGDIRKKQKITIAGQEMEVETLVAEEED |
| 223 | V1V2-421 | 0.3 | Color-tuned ChRs for multiwavelength optogenetics | — | MDYPVARSLIVRYPTDLGNGTVCMPRGQCYCEGWLRSRGTSIEKTIAITLQWVV FALSVACLGWYAYQAWRATCGWEEVYVALIEMMKSIIEAFHEFDSPATLWLSSG NGVVWMRYGEWLLTCPVILIHLSNLTGLKDDYSKRTMGLLVSDVGCIVWGATSA MCTGYIKVIFFLLGCMYGANTFFHAAKVYIESYHTVPKGGLCRQLVRAMAWLFFV SWGMFPVLFLLGPEGFGHLSVYGSAIGHSILDLIAKNMWGVLGNYLRVKIHEHI LLYGDIRKKQKITIAGQEMEVETLVAEEED |

TABLE 3-continued

ChR sequence and photocurrent data from published sources including 19 natural ChR variants, 14 point-mutant ChR variants, and 28 recombination variants from various recombination libraries.

| SEQ ID NO. | ChR name | Photo-current (nA) | Reference | Accession codes | Amino acid sequence |
|---|---|---|---|---|---|
| 224 | V1V2-322 | 0 | Color-tuned ChRs for multiwavelength optogenetics | — | MDYPVARSLIVRYPTDLGNGTVCMPRGQCYCEGWLRSRGTSIEKTIAITLQWVV FALSVACLGWYAYQAWRATCGWEEVYVALIEMMKSIIEAFHEFDSPATLWLSSG NGVVWMRYGEWLLTCPVILIHLSNLTGLKDDYNKRTMRLLVSDVGTIVWGATAA MSTGYIKVIFFLLGCMYGANTFFHAAKVYIESFHTVPKGICRELVRVMAWTFFV AWGMFPPVLFLLGTEGFGHISPYGSAIGHSILDLIAKNMWGVLGNYLRVKIHEHI LLYGDIRKKQKITIAGQEMEVETLVAEEED |
| 225 | V1V2-52 | 0.8 | Color-tuned ChRs for multiwavelength optogenetics | — | MDYPVARSLIVRYPTDLGNGTVCMPRGQCYCEGWLRSRGTSIEKTIAITLQWVV FALSVACLGWYAYQAWRATCGWEEVYVALIEMMKSIIEAFHEFDSPATLWLSSG NGVVWMRYGEWLLTCPVLLIHLSNLTGLKDDYSKRTMGLLVSDVGCIVWGATSA MCTGWTKILFFLISLSYGMYTYFHAAKVYIEAFHTVPKGICRELVRAMAWLFFV SWGMPPVLFLLGPEGFGHLSVYGSTIGHTIIDLLSKNCWGLLGHFLRLKIHEHI LLYGDIRKVQKIRVAGEELEVETLMTEEAPDTVKKSTA |
| 226 | V1V2-25 | 0 | Color-tuned ChRs for multiwavelength optogenetics | — | MDYPVARSLIVRYPTDLGNGTVCMPRGQCYCEGWLRSRGTSIEKTIAITLQWVV FALSVACLGWYAYQAWRATCGWEEVYVALIEMMKSIIEAFHEFDSPATLWLSSG NGVVWMRYGEWLLTCPVLLIHLSNLTGLKDDYNKRTMRLLVSDVGTIVWGATAA MSTGYIKVIFFLLGCMYGANTFFHAAKVYIESYHTVPKGLCRQLVRAMAWLFFV SWGMPPVLFLLGPEGFGHLSVYGSTIGHTIIDLLSKNCWGLLGHFLRLKIHEHI LLYGDIRKVQKIRVAGEELEVETLMTEEAPDTVKKSTA |
| 227 | SFO_C128S | 0.06 | Bi-stable neural state switches | — | MDYGGALSAVGRELLFVTNPVVNGSVLVPEDQCYCAGWIESRGTNGAQTASNV LQWLAAGFSILLLMFYAYQTWKSTCGWEEIYVCAIEMVKVILEFFFEFKNPSML YLATGHRVQWLRYAEWLLTSPVILIHLSNLTGLSNDYSRRTMGLLVSDIGTIVW GATSAMATGVKVIFFCLGLCYGANTFFHAAKAYIEGYHTVPKGRCRQVVTGMA WLFFVSWGMPPILFILGPEGFGVLSVYGSTVGHTIIDLMSKNCWGLLGHYLRVL IHEHILIHGDIRKTKLNIGGTEIEVETLVEDEAEAGAV |
| 228 | CatCh | 1.28 | Principles for applying optogenetic tools derived from direct comparative analysis of microbial opsins | — | MDYGGALSAVGRELLFVTNPVVNGSVLVPEDQCYCAGWIESRGTNGAQTASNV LQWLAAGFSILLLMFYAYQTWKSTCGWEEIYVCAIEMVKVILEFFFEFKNPSML YLATGHRVQWLRYAEWLLTCPVICIHLSNLTGLSNDYSRRTMGLLVSDIGTIVW GATSAMATGVKVIFFCLGLCYGANTFFHAAKAYIEGYHTVPKGRCRQVVTGMA WLFFVSWGMPPILFILGPEGFGVLSVYGSTVGHTIIDLMSKNCWGLLGHYLRVL IHEHILIHGDIRKTKLNIGGTEIEVETLVEDEAEAGAV |
| 229 | SFO_C128A | 0.07 | Bi-stable neural state switches | — | MDYGGALSAVGRELLFVTNPVVNGSVLVPEDQCYCAGWIESRGTNGAQTASNV LQWLAAGFSILLLMFYAYQTWKSTCGWEEIYVCAIEMVKVILEFFFEFKNPSML YLATGHRVQWLRYAEWLLTAPVILIHLSNLTGLSNDYSRRTMGLLVSDIGTIVW GATSAMATGVKVIFFCLGLCYGANTFFHAAKAYIEGYHTVPKGRCRQVVTGMA WLFFVSWGMPPILFILGPEGFGVLSVYGSTVGHTIIDLMSKNCWGLLGHYLRVL IHEHILIHGDIRKTKLNIGGTEIEVETLVEDEAEAGAV |

TABLE 3-continued

ChR sequence and photocurrent data from published sources including 19 natural ChR variants, 14 point-mutant ChR variants, and 28 recombination variants from various recombination libraries.

| SEQ ID NO. | ChR name | Photo-current (nA) | Reference | Accession codes | Amino acid sequence |
|---|---|---|---|---|---|
| 230 | SFO_C128T | 0.18 | Bi-stable neural state switches | — | MDYGGALSAVGRELLFVTNPVVVNGSVLVPEDQCYCAGWIESRGTNGAQTASNV LQWLAAGFSILLLMFYAYQTWKSTCGWEEIYVCAIEMVKVILEFFFEFKNPSML YLATGHRVQWLRYAEWLLTTPVILIHLSNLTGLSNDYSRRTMGLLVSDIGTIVW GATSAMATGYVKVIFFCLGLCYGANTFFHAAKAYIEGYHTVPKGRCRQVVTGMA WLFFVSWGMPPILFILGPEGFGVLSVYGSTVGHTIIDLMSKNCWGLLGHYLRVL IHEHILIHGDIRKTTKLNIGGTEIEVETLVEDEAEAGAV |
| 231 | ChR2 | 0.77 | Independent optical excitation of distinct neural populations | AF461397 | MDYGGALSAVGRELLFVTNPVVVNGSVLVPEDQCYCAGWIESRGTNGAQTASNV LQWLAAGFSILLLMFYAYQTWKSTCGWEEIYVCAIEMVKVILEFFFEFKNPSML YLATGHRVQWLRYAEWLLTCPVILIHLSNLTGLSNDYSRRTMGLLVSDIGTIVW GATSAMATGYVKVIFFCLGLCYGANTFFHAAKAYIEGYHTVPKGRCRQVVTGMA WLFFVSWGMPPILFILGPEGFGVLSVYGSTVGHTIIDLMSKNCWGLLGHYLRVL IHEHILIHGDIRKTTKLNIGGTEIEVETLVEDEAEAGAV |
| 232 | TC | 1.43 | Principles for applying optogenetic tools derived from direct comparative analysis of microbial opsins | — | MDYGGALSAVGRELLFVTNPVVVNGSVLVPEDQCYCAGWIESRGTNGAQTASNV LQWLAAGFSILLLMFYAYQTWKSTCGWEEIYVCAIEMVKVILEFFFEFKNPSML YLATGHRVQWLRYAEWLLTCPVILIHLSNLTGLSNDYSRRTMGLLVSDICIVW GATSAMATGYVKVIFFCLGLCYGANTFFHAAKAYIEGYHTVPKGRCRQVVTGMA WLFFVSWGMPPILFILGPEGFGVLSVYGSTVGHTIIDLMSKNCWGLLGHYLRVL IHEHILIHGDIRKTTKLNIGGTEIEVETLVEDEAEAGAV |
| 233 | ChETA_TC | 1.26 | Principles for applying optogenetic tools derived from direct comparative analysis of microbial opsins | — | MDYGGALSAVGRELLFVTNPVVVNGSVLVPEDQCYCAGWIESRGTNGAQTASNV LQWLAAGFSILLLMFYAYQTWKSTCGWEEIYVCAIEMVKVILEFFFEFKNPSML YLATGHRVQWLRYATWLLTCPVILIHLSNLTGLSNDYSRRTMGLLVSDIGCIVW GATSAMATGYVKVIFFCLGLCYGANTFFHAAKAYIEGYHTVPKGRCRQVVTGMA WLFFVSWGMPPILFILGPEGFGVLSVYGSTVGHTIIDLMSKNCWGLLGHYLRVL IHEHILIHGDIRKTTKLNIGGTEIEVETLVEDEAEAGAV |
| 234 | ChR2_R | 1.03 | Principles for applying optogenetic tools derived from direct comparative analysis of microbial opsins | — | MDYGGALSAVGRELLFVTNPVVVNGSVLVPEDQCYCAGWIESRGTNGAQTASNV LQWLAAGFSILLLMFYAYQTWKSTCGWEEIYVCAIEMVKVILEFFFEFKNPSML YLATGHRVQWLRYAEWLLTCPVILIRLSNLTGLSNDYSRRTMGLLVSDIGTIVW GATSAMATGYVKVIFFCLGLCYGANTFFHAAKAYIEGYHTVPKGRCRQVVTGMA WLFFVSWGMPPILFILGPEGFGVLSVYGSTVGHTIIDLMSKNCWGLLGHYLRVL IHEHILIHGDIRKTTKLNIGGTEIEVETLVEDEAEAGAV |

TABLE 3-continued

ChR sequence and photocurrent data from published sources including 19 natural ChR variants, 14 point-mutant ChR variants, and 28 recombination variants from various recombination libraries.

| SEQ ID NO. | ChR name | Photo-current (nA) | Reference | Accession codes | Amino acid sequence |
|---|---|---|---|---|---|
| 235 | ChETA_TR | 0.41 | Principles for applying optogenetic tools derived from direct comparative analysis of microbial opsins | — | MDYGGALSAVGRELLFVTNPVVVNGSVLVPEDQCYCAGWIESRGTNGAQTASNV LQWLAAGFSILLLMFYAYQTWKSTCGWEEIYVCAIEMVKVILEFFFEFKNPSML YLATGHRVQWLRYATWLLTCPVILIRLSNLTGLSNDYSRRTMGLLVSDIGTIVW GATSAMATGYVKVIFFCLGLCYGANTFFHAAKAYIEGYHTVPKGRCRQVVTGMA WLFFVSWGMPPILFILGPEGFGVLSVYGSTVGHTIIDLMSKNCWGLLGHYLRVL IHEHILIHGDIRKTTKLNIGGTEIEVETLVEDEAEAGAV |
| 236 | ChETA_AR | 0.3 | Principles for applying optogenetic tools derived from direct comparative analysis of microbial opsins | — | MDYGGALSAVGRELLFVTNPVVVNGSVLVPEDQCYCAGWIESRGTNGAQTASNV LQWLAAGFSILLLMFYAYQTWKSTCGWEEIYVCAIEMVKVILEFFFEFKNPSML YLATGHRVQWLRYAAWLLTCPVILIRLSNLTGLSNDYSRRTMGLLVSDIGTIVW GATSAMATGYVKVIFFCLGLCYGANTFFHAAKAYIEGYHTVPKGRCRQVVTGMA WLFFVSWGMPPILFILGPEGFGVLSVYGSTVGHTIIDLMSKNCWGLLGHYLRVL IHEHILIHGDIRKTTKLNIGGTEIEVETLVEDEAEAGAV |
| 237 | ChETA_A | 0.39 | Principles for applying optogenetic tools derived from direct comparative analysis of microbial opsins | — | MDYGGALSAVGRELLFVTNPVVVNGSVLVPEDQCYCAGWIESRGTNGAQTASNV LQWLAAGFSILLLMFYAYQTWKSTCGWEEIYVCAIEMVKVILEFFFEFKNPSML YLATGHRVQWLRYAAWLLTCPVILIHLSNLTGLSNDYSRRTMGLLVSDIGTIVW GATSAMATGYVKVIFFCLGLCYGANTFFHAAKAYIEGYHTVPKGRCRQVVTGMA WLFFVSWGMPPILFILGPEGFGVLSVYGSTVGHTIIDLMSKNCWGLLGHYLRVL IHEHILIHGDIRKTTKLNIGGTEIEVETLVEDEAEAGAV |
| 238 | ChETA_T | 0.64 | Ultrafast optogenetic control | — | MDYGGALSAVGRELLFVTNPVVVNGSVLVPEDQCYCAGWIESRGTNGAQTASNV LQWLAAGFSILLLMFYAYQTWKSTCGWEEIYVCAIEMVKVILEFFFEFKNPSML YLATGHRVQWLRYATWLLTCPVILIHLSNLTGLSNDYSRRTMGLLVSDIGTIVW GATSAMATGYVKVIFFCLGLCYGANTFFHAAKAYIEGYHTVPKGRCRQVVTGMA WLFFVSWGMPPILFILGPEGFGVLSVYGSTVGHTIIDLMSKNCWGLLGHYLRVL IHEHILIHGDIRKTTKLNIGGTEIEVETLVEDEAEAGAV |
| 239 | Abcdefg1 | 0.23 | Molecular determinants differentiating photocurrent properties of two ChRs from chlamydomonas. | — | MSRRPWLLALALAVALAAGSAGASTGSDATVPVATQDGPDYVFHRAHERMLFQT SYTLENNGSVICIPNNGQCFCLAWLKSNGTNAEKLAANILQWITFALSALCLMF WLLTCPVILIHLSNLTGLSNDYSRRTMGLLVSDIGTIVWGATSAMATGYVKVIF FCLGLCYGANTFFHAAKAYIEGYHTVPKGRCRQVVTGMAWLFFVSWGMPPILFI LGPEGFGVLSVYGSTVGHTIIDLMSKNCWGLLGHYLRVLIHEHILIHGDIRKTT KLNIGGTEIEVETLVEDEAEAGAVNKGTGK |

TABLE 3-continued

ChR sequence and photocurrent data from published sources including 19 natural ChR variants, 14 point-mutant ChR variants, and 28 recombination variants from various recombination libraries.

| SEQ ID NO. | ChR name | Photo-current (nA) | Reference | Accession codes | Amino acid sequence |
|---|---|---|---|---|---|
| 240 | ChR1 | 0.08 | Independent optical excitation of distinct neural populations | AF385748 | MSRRPWLLALALAVALAAGSAGASTGSDATVPVATQDGPDYVFHRAHERMLFQT SYTLENNGSVICIPNNGQCFCLAWLKSNGTNAEKLAANILQWITFALSALCLMF YGYQTWKSTCGWEEIYVATIEMIKFIIEYFHEFDEPAVIYSSNGNKTVWLRYAE WLLTCPVILIHLSNLTGLANDYNKRTMGLLVSDIGTIVWGTTAALSKGYVRVIF FLMGLCYGIYTFFNAAKVYIEAYHTVPKGICRDLVRYLAWLYFCSWAMPPVLFL LGPEGFGHINQFNSAIAHAILDLASKNAWSMMGHFLRVKIHEHILLYGDIRKKQ KVNVAGQEMEVETMVHEEDD |
| 241 | ChR_f | 0.17 | Opto-current-clamp actuation of cortical neurons using a strategically designed ChR. | — | MSRRPWLLALALAVALAAGSAGASTGSDATVPVATQDGPDYVFHRAHERMLFQT SYTLENNGSVICIPNNGQCFCLAWLKSNGTNAEKLAANILQWITFALSALCLMF YGYQTWKSTCGWEEIYVATIEMIKFIIEYFHEFDEPAVIYSSNGNKTVWLRYAE WLLTCPVILIHLSNLTGLANDYNKRTMGLLVSDIGTIVWGTTAALSKGYVRVIF FLMGLCYGIYTFFNAAKVYIEAYHTVPKGRCRQVVTGMAWLFFVSWGMPPILFL LGPEGFGHINQFNSAIAHAILDLASKNAWSMMGHFLRVKIHEHILLYGDIRKKQ KVNVAGQEMEVETMVHEEDD |
| 242 | GR | 0.43 | Principles for applying optogenetic tools derived from direct comparative analysis of microbial opsins' | — | MSRRPWLLALALAVALAAGSAGASTGSDATVPVATQDGPDYVFHRAHERMLFQT SYTLENNGSVICIPNNGQCFCLAWLKSNGTNAEKLAANILQWITFALSALCLMF YGYQTWKSTCGWEEIYVATIEMIKFIIEYFHEFDEPAVIYSSNGNKTVWLRYAE WLLTCPVILIHLSNLTGLANDYNKRTMGLLVSDIGTIVWGTTAALSKGYVRVIF FLMGLCYGIYTFFNAAKVYIEAYHTVPKGRCRQVVTGMAWLFFVSWGMPPILFL LGPEGFGHINQFNSAIAHAILDLASKNCWGLLGHYLRVLIHEHILIHGDIRKTT KLNIGGTEIEVETLVEDEAEAGAVNKGTGK |
| 243 | ABCDEFg6 | 0.06 | Molecular determinants differentiating photocurrent properties of two ChRs from chlamydomonas. | — | MSRRPWLLALALAVALAAGSAGASTGSDATVPVATQDGPDYVFHRAHERMLFQT SYTLENNGSVICIPNNGQCFCLAWLKSNGTNAEKLAANILQWITFALSALCLMF YGYQTWKSTCGWEEIYVATIEMIKFIIEYFHEFDEPAVIYSSNGNKTVWLRYAE WLLTCPVILIHLSNLTGLANDYNKRTMGLLVSDIGTIVWGTTAALSKGYVRVIF FLMGLCYGIYTFFNAAKVYIEAYHTVPKGICRDLVRYLAWLYFCSWAMPPVLFL LGPEGFGVLSVYGSTVGHTIIDLMSKNCWGLLGHYLRVLIHEHILIHGDIRKTT KLNIGGTEIEVETLVEDEAEAGAVNKGTGK |
| 244 | ChF | 0.09 | Characterization of engineered channelrhodopsin variants with improved properties and kinetics. | — | MSRRPWLLALALAVALAAGSAGASTGSDATVPVATQDGPDYVFHRAHERMLFQT SYTLENNGSVICIPNNGQCFCLAWLKSNGTNAEKLAANILQWITFALSALCLMF YGYQTWKSTCGWEEIYVATIEMIKFIIEYFHEFDEPAVIYSSNGNKTVWLRYAE WLLTCPVILIHLSNLTGLANDYNKRTMGLLVSDIGTIVWGTTAALSKGYVRVIF FLMGLCYGIYTFFNAAKVYIEAYHTVPKGICRDLVRYLAWLYFCSWAMPPVLFL LGPEGFGVLSVYGSTVGHTIIDLMSKNCWGLLGHYLRVLIHEHILIHGDIRKTT KLNIGGTEIEVETLVEDEAEAGAVNKGTGK |

TABLE 3-continued

ChR sequence and photocurrent data from published sources including 19 natural ChR variants, 14 point-mutant ChR variants, and 28 recombination variants from various recombination libraries.

| SEQ ID NO. | ChR name | Photo-current (nA) | Reference | Accession codes | Amino acid sequence |
|---|---|---|---|---|---|
| 245 | ABCDEfg5 | 0.41 | Molecular determinants differentiating photocurrent properties of two ChRs from chlamydomonas. | — | MSRRPWLLALALAVALAAGSAGASTGSDATVPVATQDGPDYVFHRAHERMLFQT SYTLENNGSVICIPNNGQCFCLAWLKSNGTNAEKLAANILQWITFALSALCLMF YGYQTWKSTCGWEEIYVATIEMIKFIIEYFHEFDEPAVIYSSNGNKTVWLRYAE WLLTCPVILIHLSNLTGLANDYNKRTMGLLVSDIGTIVWGTTAALSKGYVRVIF FLMGLCYGIYTFFNAAKVYIEAYHTVPKGRCRQVVTGMAWLFFVSWGMPPILFI LGPEGFGVLSVYGSTVGHTIIDLMSKNCWGLLGHYLRVLIHEHILIHGDIRKTT KLNIGGTEIEVETLVEDEAEAGAVNKGTGK |
| 246 | ChEF | 1.06 | Characterization of engineered channelrhodopsin variants with improved properties and kinetics. | — | MSRRPWLLALALAVALAAGSAGASTGSDATVPVATQDGPDYVFHRAHERMLFQT SYTLENNGSVICIPNNGQCFCLAWLKSNGTNAEKLAANILQWITFALSALCLMF YGYQTWKSTCGWEEIYVATIEMIKFIIEYFHEFDEPAVIYSSNGNKTVWLRYAE WLLTCPVILIHLSNLTGLANDYNKRTMGLLVSDIGTIVWGTTAALSKGYVRVIF FLMGLCYGIYTFFNAAKVYIEAYHTVPKGRCRQVVTGMAWLFFVSWGMPPILFI LGPEGFGVLSVYGSTVGHTIIDLMSKNCWGLLGHYLRVLIHEHILIHGDIRKTT KLNIGGTEIEVETLVEDEAEAGAVNKGTGK |
| 247 | ChIEF | 1.41 | Principles for applying optogenetic tools derived from direct comparative analysis of microbial opsins' | — | MSRRPWLLALALAVALAAGSAGASTGSDATVPVATQDGPDYVFHRAHERMLFQT SYTLENNGSVICIPNNGQCFCLAWLKSNGTNAEKLAANILQWITFALSALCLMF YGYQTWKSTCGWEEIYVATIEMIKFIIEYFHEFDEPAVIYSSNGNKTVWLRYAE WLLTCPVILIHLSNLTGLANDYNKRTMGLLVSDIGTIVWGTTAALSKGYVRVIF FLMGLCYGIYTFFNAAKVYIEAYHTVPKGRCRQVVTGMAWLFFVSWGMPPILFI LGPEGFGVLSVYGSTVGHTIIDLMSKNCWGLLGHYLRVLIHEHILIHGDIRKTT KLNIGGTEIEVETLVEDEAEAGAVNKGTGK |
| 248 | ABCDefg4 | 0.35 | Molecular determinants differentiating photocurrent properties of two ChRs from chlamydomonas. | — | MSRRPWLLALALAVALAAGSAGASTGSDATVPVATQDGPDYVFHRAHERMLFQT SYTLENNGSVICIPNNGQCFCLAWLKSNGTNAEKLAANILQWITFALSALCLMF YGYQTWKSTCGWEEIYVATIEMIKFIIEYFHEFDEPAVIYSSNGNKTVWLRYAE WLLTCPVILIHLSNLTGLANDYNKRTMGLLVSDIGTIVWGTTAALSKGVKVIF FCLGLCYGANTFFHAAKAYIEGYHTVPKGRCRQVVTGMAWLFFVSWGMPPILFI LGPEGFGVLSVYGSTVGHTIIDLMSKNCWGLLGHYLRVLIHEHILIHGDIRKTT KLNIGGTEIEVETLVEDEAEAGAVNKGTGK |
| 249 | ChD | 1.24 | Characterization of engineered channelrhodopsin variants with improved properties and kinetics. | — | MSRRPWLLALALAVALAAGSAGASTGSDATVPVATQDGPDYVFHRAHERMLFQT SYTLENNGSVICIPNNGQCFCLAWLKSNGTNAEKLAANILQWITFALSALCLMF YGYQTWKSTCGWEEIYVATIEMIKFIIEYFHEFDEPAVIYSSNGNKTVWLRYAE WLLTCPVILIHLSNLTGLANDYNKRTMGLLVSDIGTIVWGATSAMATGVKVIF FCLGLCYGANTFFHAAKAYIEGYHTVPKGRCRQVVTGMAWLFFVSWGMPPILFI LGPEGFGVLSVYGSTVGHTIIDLMSKNCWGLLGHYLRVLIHEHILIHGDIRKTT KLNIGGTEIEVETLVEDEAEAGAVNKGTGK |

TABLE 3-continued

ChR sequence and photocurrent data from published sources including 19 natural ChR variants, 14 point-mutant ChR variants, and 28 recombination variants from various recombination libraries.

| SEQ ID NO. | ChR name | Photo-current (nA) | Reference | Accession codes | Amino acid sequence |
|---|---|---|---|---|---|
| 250 | ABCdefg2 | 0.41 | Molecular determinants differentiating photocurrent properties of two ChRs from chlamydomonas. | — | MSRRPWLLALALAVALAAGSAGASTGSDATVPVATQDGPDYVFHRAHERMLFQT SYTLENNGSVICIPNNGQCFCLAWLKSNGTNAEKLAANILQWITFALSALCLMF YGYQTWKSTCGWEEIYVATIEMIKFIIEYFHEFDEPAVIYSSNGNKTVWLRYAE WLLTCPVLILHLSNLTGLSNDYSRRTMGLLVSDIGTIVWGATSAMATGVVKIF FCLGLCYGANTFFHAAKAYIEGYHTVPKGRCRQVVTGMAWLFFVSWGMPPILFI LGPEGFGVLSVYGSTVGHTIIDLMSKNCWGLLGHYLRVLIHEHILIHGDIRKTT KLNIGGTEIEVETLVEDEAEAGAVNKGTGK |
| 251 | ABCdefg3 | 0.49 | Molecular determinants differentiating photocurrent properties of two ChRs from chlamydomonas. | — | MSRRPWLLALALAVALAAGSAGASTGSDATVPVATQDGPDYVFHRAHERMLFQT SYTLENNGSVICIPNNGQCFCLAWLKSNGTNAEKLAANILQWITFALSALCLMF YGYQTWKSTCGWEEIYVATIEMIKFIIEYFHEFDEPAVIYSSNGNKTVWLRYAE WLLTCPVILIHLSNLTGLANDYSRRTMGLLVSDIGTIVWGATSAMATGVVKIF FCLGLCYGANTFFHAAKAYIEGYHTVPKGRCRQVVTGMAWLFFVSWGMPPILFI LGPEGFGVLSVYGSTVGHTIIDLMSKNCWGLLGHYLRVLIHEHILIHGDIRKTT KLNIGGTEIEVETLVEDEAEAGAVNKGTGK |
| 252 | C1V1-52 | 0.2 | Color-tuned ChRs for multiwavelength optogenetics. | — | MSRRPWLLALALAVALAAGSAGASTGSDATVPVATQDGPDYVFHRAHERMLFQT SYTLENNGSVICIPNNGQCFCLAWLKSNGTNAEKLAANILQWITFALSALCLMF YGYQTWKSTCGWEEIYVATIEMIKFIIEYFHEFDEPAVIYSSNGNKTVWLRYAE WLLTCPVILIHLSNLTGLANDYNKRTMGLLVSDIGTIVWGTTAALSKGYVRVIF FLMGLCYGIYTFFNAAKVYIEAYHTVPKGICRDLVRVMAWTFFVAWGMPPVLFL GTEGFGHISPYGSAIGHSILDLIAKNMGVLGNYLRVKIHEHILLYGDIRKKQ KITIAGQEMEVETLVAEEED |
| 253 | C_VChR1 | 0.07 | ReaChR: a red-shifted variant of channelrhodopsin enables deep transcranial optogenetic excitation | — | MVSRRPWLLALALAVALAAGSAGASTGSDATVPVATQDGPDYVFHRAHERMLFQ TSYTLENNGSVICIPNNGQCFCLAWLKSNGTNAEKLAANILQWVFALSVACLG WYAYQAWRATCGWEVYVALIEMMKSIIEAFHEFDSPATLWLSSGNGVVWMRYG EWLLTCPVLLIHLSNLTGLKDDYSKRTMGLLVSDVGCIVWGATSAMCTGWTKIL FFLISLSYGMYTYFHAAKVYIEAFHTVPKGICRELVRVMAWTFFVAWGMPPVLF LLGTEGFGHISPYGSAIGHSILDLIAKNMWGVLGNYLRVKIHEHILLYGDIRKK QKITIAGQEMEVETLVAEEED |
| 254 | bReaChES | 1.37 | Projections from neocortex mediate top-down control of memory retrieval | AME16506.1 | MDYGGALSAVGLFQTSYTLENNGSVICIPNNGQCFCLAWLKSNGTNAEKLAANI LQWVFALSVACLGWYAYQAWRATCGWEEVYVALIEMMKSIIEAFHEFDSPATL WLSSGNGVVWMRYGSWLLTCPVILIHLSNLTGLKDDYSKRTMGLLVSDVGCIVW GATSAMCTGWTKILFFLISLSYGMYTYFHAAKVYIEAFHTVPKGLCRQLVRAMA WLFFVSWGMPPVLFLLGPEGFGHISPYGSAIGHSILDLIAKNMWGVLGNYLRVK IHEHILLYGDIRKKQKITIAGQEMEVETLVAEEED |

TABLE 3-continued

ChR sequence and photocurrent data from published sources including 19 natural ChR variants,
14 point-mutant ChR variants, and 28 recombination variants from various recombination libraries.

| SEQ ID NO. | ChR name | Photo-current (nA) | Reference | Accession codes | Amino acid sequence |
|---|---|---|---|---|---|
| 255 | ReaChR | 0.67 | ReaChR: a red-shifted variant of channelrhodopsin enables deep transcranial optogenetic excitation | KF448069 | MVSRRPWLLALALAVALAAGSAGASTGSDATVPVATQDGPDYVFHRAHERMLFQ TSYTLENNGSVICIPNNGQCFCLAWLKSNGTNAEKLAANILQWVVFALSVACLG WYAYQAWRATCGWEEVYVALIEMMKSIIEAFHEFDSPATLWLSSGNGVVWMRYG EWLLTCPVLIIHLSNLTGLKDDYSKRTMGLLVSDVGCIVWGATSAMCTGWTKIL FFLISLSYGMYTYFHAAKVYIEAPHTVPKGLCRQLVRAMAWLFFVSWGMPPVLF LLGPEGFGHISPYGSAIGHSILDLIAKNMWGVLGNYLRVKIHEHILLYGDIRKK QKITIAGQEMEVETIVAEEEDKYESS |
| 256 | VCOMET | 0.4 | ReaChR: a red-shifted variant of channelrhodopsin enables deep transcranial optogenetic excitation | KF448070 | MVSRRPWLLALALAVALAAGSAGASTGSDATVPVATQDGPDYVFHRAHERMLFQ TSYTLENNGSVICIPNNGQCFCLAWLKSNGTNAEKLAANILQWVVFALSVACLG WYAYQAWRATCGWEEVYVALIEMMKSIIEAFHEFDSPATLWLSSGNGVVWMRYG EWLLTCPVLIIHLSNLTGLKDDYSKRTMGLLVSDVGCIVWGATSAMCTGWTKIL FFLISLSYGMYTYFHAAKVYIEAPHTVPKGLCRQLVRAMAWLFFVSWGMPPVLF LLGPEGFGHISPYGSAIGHSILDLIAKNMWGVLGNYLRVKIHEHILLYGDIRKK QKITIAGQEMEVETIVAEEEDKYESS |
| 257 | C1V1_T1 | 0.32 | Neocortical excitation/inhibition balance in information processing and social dysfunction. | — | MSRRPWLLALALAVALAAGSAGASTGSDATVPVATQDGPDYVFHRAHERMLFQT SYTLENNGSVICIPNNGQCFCLAWLKSNGTNAEKLAANILQWITFALSALCLMF YGYQTWKSTCGWETIYVATIEMIKFIIEYHEFDEPAVIYSSNGNKTVWLRYAE WLLTCPVLLIHLSNLTGLKDDYSKRTMGLLVSDVGCIVWGATSAMCTGWTKILF FLISLSYGMYTYFHAAKVYIEAFHTVPKGICRELVRVMAWTFFVAWGMPPVLFL LGTEGFGHISPYGSAIGHSILDLIAKNMWGVLGNYLRVKIHEHILLYGDIRKKQ KITIAGQEMEVETIVAEEED |
| 258 | C1V1 | 0.6 | Neocortical excitation/inhibition balance in information processing and social dysfunction. | — | MSRRPWLLALALAVALAAGSAGASTGSDATVPVATQDGPDYVFHRAHERMLFQT SYTLENNGSVICIPNNGQCFCLAWLKSNGTNAEKLAANILQWITFALSALCLMF YGYQTWKSTCGWEEIYVATIEMIKFIIEYFHEFDEPAVIYSSNGNKTVWLRYAE WLLTCPVLLIHLSNLTGLKDDYSKRTMGLLVSDVGCIVWGATSAMCTGWTKILF FLISLSYGMYTYFHAAKVYIEAFHTVPKGICRELVRVMAWTFFVAWGMPPVLFL LGTEGFGHISPYGSAIGHSILDLIAKNMWGVLGNYLRVKIHEHILLYGDIRKKQ KITIAGQEMEVETIVAEEED |

TABLE 3-continued

ChR sequence and photocurrent data from published sources including 19 natural ChR variants, 14 point-mutant ChR variants, and 28 recombination variants from various recombination libraries.

| SEQ ID NO. | ChR name | Photo-current (nA) | Reference | Accession codes | Amino acid sequence |
|---|---|---|---|---|---|
| 259 | C1V1_TT | 0.78 | Principles for applying optogenetic tools derived from direct comparative analysis of microbial opsins' | — | MSRRPWLLALALAVALAAGSAGASTGSDATVPVATQGPDYVFHRAHERMLFQT SYTLENNGSVICIPNNGQCFCLAWLKSNGTNAEKLAANILQWITFALSALCLMF YGYQTWKSTCGWETIYVATIEMIKFIIEYFHEFDEPAVIYSSNGNKTVWLRYAT WLLTCPVLLIHLSNLTGLKDDYSKRTMGLLVSDVGCIVWGATSAMCTGWTKILF FLISLSYGMYTYFHAAKVYIEAFHTVPKGICRELVRVMAWTFFVAWGMPPVLFL LGTEGFGHISPYGSAIGHSILDLIAKNMWGVLGNYLRVKIHEHILLYGDIRKKQ KITIAGQEMEVETLVAEEED |
| 260 | C1V1_T2 | 1.21 | Neocortical excitation/ inhibition balance in information processing and social dysfunction. | — | MSRRPWLLALALAVALAAGSAGASTGSDATVPVATQGPDYVFHRAHERMLFQT SYTLENNGSVICIPNNGQCFCLAWLKSNGTNAEKLAANILQWITFALSALCLMF YGYQTWKSTCGWEEIYVATIEMIKFIIEYFHEFDEPAVIYSSNGNKTVWLRYAT WLLTCPVLLIHLSNLTGLKDDYSKRTMGLLVSDVGCIVWGATSAMCTGWTKILF FLISLSYGMYTYFHAAKVYIEAFHTVPKGICRELVRVMAWTFFVAWGMPPVLFL LGTEGFGHISPYGSAIGHSILDLIAKNMWGVLGNYLRVKIHEHILLYGDIRKKQ KITIAGQEMEVETLVAEEED |

TABLE 4

Alignment of truncated ChR sequences

| SEQ ID NO. | ChR name | Aligned amino acid sequence |
|---|---|---|
| 261 | PsChR1 | MTTISEVCGVWALDNPECIEVS----------GTNDNVKMAQLC----FCMVCVCQILFMASQYPKV---------GW-EAIYLPSCECFLYGLAS------SGNGFIQLYDGRLIPWA---RYAAWICTCPSILLQINTIHCCKISHFNLNIFIVQADLIMNIMGVTGALTNIAFK---WIYFAIGCILFIFIVLVVYDIMISAAK--EMKAKGDSKGNLVSTRLILLRWIFIVSWCVPLLWILLSPQATCAVSEDVISVAHFICDAFAKNMFGFI--MWRILW------------RDLDGHWDISRH-----YPQSSYAKDG-KEEEQMTAMSQTD |
| 262 | PsChR2 | TMLEHLEGTMD---------GWYAENDLG---QGAIIAHWVIPFFHMITTFYLGYVSPHSKGPGGKQPYFAGYHEENNIGIFVNLFAAISYFGKVVSDTHGHNYQNVGPFIIGLGNYRYADYMLTCPLLVMDL-LFQLRAPY-KITCAMLI--FAVLMIGAVINFYPGDDMKGPAVAWFCFGCFWYLIAYIFMAHIVSKQYGRLDYLAHGTKAEG-ALFSLKLAIIIPFAIWVAFPLVWLLSV-GTGVLSNEAAEICHCICDVVAKSVYGFALANFREQY------DRELYGL-----L---NSIGLD-GE--DVVQQLEKE |
| 263 | MITChR1 | EEDCVTIRYFVENDFEGCIPGH-----FDQYSSHGSLHDIVKAAL--YICMVISILQILFYGFQWWRKTC--------GW-EVWFVACIETSIYIIAITSEA--DSPFTLYLINGQISPQL---RYMEWLMTCPVILIALSNITGMAEEYNKRIMLLTSDVCCIVLGMMSAAS-KPRLK---GILYAVGWAFGAWTYWTALQVVRDAH------KAVPKPL-AW-YVRAMGYVFFTSWLIFPGWFLLGPEGLEVVIGIVSTLMHACSDLISKNLWGFMDWHLRVLVARHHRKLFKAEEE---HALKKGQTLEPGMPRSTSFVRGLGDDVEI--- |
| 264 | SdChR | EYHAPAGYQVNPPYHPVHGYEE---QCSSIYIYYGALWEQETARGFQWFAVFLSALFLAFYGWHAYKASV--------GW-BEVYVCSVELIKVILEIYFEF--TSPAMLFLYGGNITPWL---RYAEWLLTCPVILIHLSNITGLSEEYNKRTMALLVSDLGTICMGVTAALA-TGWVK---WLFYCIGLVYGTQTFYNAGIIYVESY------HE--YIMPAGG-CKKLIVLAMTAVYYSSWLMFPGLFIFGPEGMHTLSVAGSTIGHTIADLLSKNIWGLLGHFLRIKI-------HIIMYGD-----IRRPVSSQFL-GRKVDVLAFVTEE |
| 265 | TcChR | ----MGWKINPLYSDEVAILE---ICKENEMVFGPLWEQKLARALQWFTVILSAIFLPAYVVYSTLRATC--------GW-EELYVCCTVEFTKVVVEYLEY--VPPFMIYQMNGQHTPWL---RYMEWLLTCPVILIHLSNITGLNDEYSGRIMSLLTSDLGGIAFAVLSALA-VGWQK---GLYFGIGCIYGASTFYHAACIYIESY------HE--HTMPAGK-CKRLVVAMCAVPFTSWFMFPALFLAGPECFDGLIWSGSTIAHTVADLLSKNIWGLIGHFLRVGI-------HILVHGD-----VRRPIEVTIF-GKETSLNCFVEND |
| 266 | TsChR | ----MFAINPEYMNETVLLD---ECTPIYLDIGPLWEQVVARVTQWFGVILSLVFLIYYIWNTYKATC---------GW-EELYVCTVEFCKIIIELYFEY--TPPAMIFQINGQVIPWL---RYAEWLLTCPVILSNITGLNDDYSGRIMSLLITSDLGLGICMAVTAALS-KGWLK---ALFFVIGCGYGASTFYNAACIYIESY------HK--YTMPQGI-CRRLVLMMAGVPFTSWFMFPGLFLAGPEGTQALSWAGITIGHTVADLLSKNAWGMIGHFLRVEI-------HIIIHGD-----VRRPVTVKAL-GRQVSVNCFVDKE |
| 267 | CbChR1 | YAGYTYCFSELAFGKLVMVPEA----DAGWLHSHGTQAEFVAATACQYTALSLALLLLSFYAYSAWKATC--------EEGYVCCVEVLFVTLEISNEF--NSPATLYLSIGNYCYFL---RYGEWLLSCPVLIHLSNLSGLKNDYSMRTMRLLVSCIGMLITGMAGGLG-VGWVK---WILYFVSCAYSAQTYLQAAKCYVEVI------HE--ATVPKGY-CRIVVKLMAYAFFTAWGAYPILWAIGPEGLKYISGYSNTIAHTFCDILAKEIWTFLGHHLRIKI-------HILIHGD-----IRKKVQVRVA-GELMNVEELMEEE |

TABLE 4-continued

Alignment of truncated ChR sequences

| SEQ ID NO. | ChR name | Aligned amino acid sequence |
|---|---|---|
| 268 | Chrimson | DAGYGYCFVEATGGYLVVGVEK----KQAWLHSRGTPGEKIGAQVCQMIAPSIAIALLIFYGFSAWKATC--------GW-EEVYVCCVEVLFVTLEIFKEF--SSPATVLSIGNHAYCL---RYFEWLLSCPVILIKLSNLSGLKNDYSKRTMGLIVSCVGMIVFGMAAGLA-TDWLK---WLLYIVSCIYGGYMYFQAAKCYVEAN-----HSVPKGH-CRMVVKLMAYAFPASWGSYPILWAVGPEGLLIKLSPYANSIGHSICDIIAKEFWTFLAHHLRIKI------HE----HILIHGD-----IRKTKMEIG-GEEVEEFVEEE |
| 269 | Chronos | DAHGETSNATTAGADHGCFPHI----------NHGTELQHKIAVGLQWFTVIVAIVQLIFYGWHSFKATT--------GW-EEVYVCVIELVKCFIELFHEV--DSPATVYQINGGAVIWL---RYSMWLLTCPVILIHLSNLIGLHEEYSKRTMTILVIDIGNIVWGITAAFT-KGPLK----ILFFMIGLFYGVICFFQIAKVYIESY-----HTLPKGV-CRKICKIMAYVFFCSWLMPPVMFIAGHEGLGLITPYTSGIGHLILDLISKNIWGFLGHHLRVKI------HE----HILIHGD-----IRKTITINVA-GENMEIETFVDEE |
| 270 | HdChR | DAGYGHWYQGTPNGTLVCSHED----NIAWLKNKGTDEEMLGANICMWMAFAACLLCLSFYAYSTWRATC--------GW-EEVYVCLVEMVKVMIEVFHEN--DSPATLYLSIGNFIMWI---RYGEWLLSCPVILIHLSNITGLQDQYSKRTMQLLVSDLGTITMGVTAALC-GNYVK---WIFFILGLCYGVNTYPHAAKVYIESY-----HIVPKGV-CRVCVRVMAWCFFGAWTCYPLLFVFGPEGLGVLSYNASAIGHTIIDIFSKQVWGFVGHYLRIKI------HE----HIVIHGN-----LVKPTKVKVA-GMEIDAEEMVEKD |
| 271 | BsChR2 | DAGYQHFWTQRQNETVVCEHYT----HASWLISHGTKAEKTAMIACQWFAFGSAVLILLLYAWHTWKATS--------GW-EEVYVCCVELVKVLFEIYHEI--HHPCTLYLVIGNFILWL---RYGEWLLTCPVILIHLSNITGLKNDYINKRTMQLLVSDIGCVVWGVTAALC-YDYKK---WIFFCLGLVYGCNTYPHAAKVYIEGY-----HTVPKGE-CRIIVKVMAGVFYCSWILFPLLFLLGPEGTGFAFSAYGSTIAHTVADVLSKQLWGLLGHHLRVKI------HE----HIIIHGN-----LTVSKKVKVA-GVEVETQEMVDST |
| 272 | CnChR2 | DAKYDYCYVKAAYGELAIVETS----RLPWLYSHGSDAEHQGALAMQWMARFALCIICLVFFYAYHSWKATT--------GW-EEVYVCCVELVKVLLEIYKEF--ESPASIYLPTANAALWL---RYGEWLLTCPVILIHLSNITGLKDDYNKRTMQLLVSDIGCVVWGITAAFS-VGWLK---WVFFVLGLLYGSNTYPHAAKVYIESY-----HTVPKGH-CRLIVRLMAYCFYVAWTMYPILFILGPEGLGHMSAYMSTALHGVADMLSKQIWGLLGHHLRVKI------FE----HILIHGD-----IRKTITMQVG-GQMVQVEEMVDEE |
| 273 | CsChR | GFDELAKGAVVPEDHFVCGPAD-KCYCSAWLHSHGSKEEKTAFTVMQWIVPAVCIISLLFYAYQTWRATC--------GW-EEVYVTIIELVHVCFGLWHEV--DSPCTLYLSIGNMVLWL---RYAEWLLTCPVILIHLSNLIGMKNDYINKRTMALLVSDVGCIVWGITAALS-TDFVK----IIFFFPLGLLYGFYIFYAAAKIYIEAY-----HTVPKGI-CRQLVRLQAYDFFTWSMFPILFMVGPEGFGKITAYSSGIAHEVCDLLSKNLWGLMGHFIRVKI------HE----HILVHGN-----ITKKTKVNVA-GDMVELDTYVDQD |
| 274 | AgChR | YSNYYFLNATNSTHKWVAGPED-DCFCKAWTENRGSDEESVAAFAIAWVVBSLSVIQLLYYAYAQWRSTC--------GW-EEVYVGIIELTHICIAIFREF--DSPAMLYLSIGNEVVWA---RYASWLLSCPVILIHLSNLTGMKGNYSKRTMALLVSDIGTIVWGSTSAMSPHNHVK---IIFFELGLIVEGLFTFYAAAKVLEAY-----HTVPKGK-CRNIVRFMAWTYYVTWALFPLIFILGPEGFGHITYGSSIGHYVLEIFSKNLWSGTGHYLRLKI------HE----HIILHGN-----LTKKKTKINIA-GEPLEVEEVEAD |

TABLE 4-continued

Alignment of truncated ChR sequences

| SEQ ID NO. | ChR name | Aligned amino acid sequence |
|---|---|---|
| 275 | NsChR | GNGGPSAMVSHYPNGSVLLESSGSCYCEDWYTSRGNHVEHSLSNACDWFAFAISVIELVYYAWAAENSSV-------GW-<br>EEIYVCTVELIKVSIDQFLSS--NSPCTLYLSTGNRVLWI---<br>RYGEWLLTCPVLIHLSNVTGLKDNYSKRTMALLVSDIGTIVEGVTSAMC-TGYPK---VIFFILGCCYGANTFFNAAKVYLEAH------<br>-HTLPKGS-CRTLIRLMAYTYASWGMFPILFVLGPESFGHMNMYQSNIAHTVIDLMSKNIWGMLGHFLRHKI--------RE---<br>HILIHGD----LRTTTTVNVA-GEEMQVETMVAAE |
| 276 | CoChR | --------MLGNGSAIVPID-QCFCLAWTDSLGSDTEQLVANILQWFAFGFSILILMFYAYQTWRATC-------GW-<br>EEVYVCCVELTKVIIEFFHEF--DDDPSMLYLANGHRVQWL---<br>RYAEWLLTCPVLIHLSNLTGLKDDYSKRTMRLLVSDVGTIVWGATSAMS-TGYVK---VIFFVLGCIYGANTFFHAAKVYIESY-----<br>-HVVPKGR- PRIVVRIMAWLEFLSWGMFPVLEVVGPEGFDAISVYGSTIGHTIIDLMSKNCWGLLGHYLRVLI---------HQ---<br>HIIIYGD----IRKKTKINVA-GEEMEVETMVDQE |
| 277 | V2V1-43 | RSLIGSSYTNLNNGSIV-IPSD-ACFCMKWLKSKGSPVALKMANALQWAAFALSVILIYYAYATWRTTC--------GW-<br>EEVYVCCVELTKVVIEFFHEF--DEPGMLYLANGNRVLWL---<br>RYGEWLLTCPVLIHLSNLTGLKDDYNKRTMRLLVSDVGTIVWGATSAMC-TGWTK---ILFFLISLSYGMYTYFPHAAKVYIEAAF------<br>-HTVPKGI-CRELVRVMAWTFEVAWGMFPPVLELLGTEGFGHISPYGSAIGHSILDLIAKNMWGVLGNYLRVKI---------HE---<br>HILLYGD-----IRKKQKITIA-GQEMEVETIVAEE |
| 278 | V2V1-25 | RSLIGSSYTNLNNGSIV-IPSD-ACFCMKWLKSKGSPVALKMANALQWAAFALSVILIYYAYATWRTTC--------GW-<br>EEVYVCCVELTKVVIEFFHEF--DEPGMLYLANGNRVLWL---<br>RYGEWLLTCPVLIHLSNLTGLKDDYSKRTMGLLVSDVGCIVWGATSAMC-TGWTK---ILFFLISLSYGMYTYFPHAAKVYIEAAF------<br>-HTVPKGI-CRELVRVMAWTFEVAWGMFPVLELLGTEGFGHISPYGSAIGHSILDLIAKNMWGVLGNYLRVKI---------HE---<br>HILLYGD-----IRKKQKITIA-GQEMEVETIVAEE |
| 279 | V2V1-52 | RSLIGSSYTNLNNGSIV-IPSD-ACFCMKWLKSKGSPVALKMANALQWAAFALSVILIYYAYATWRTTC--------GW-<br>EEVYVCCVELTKVVIEFFHEF--DEPGMLYLANGNRVLWL---<br>RYGEWLLTCPVLIHLSNLTGLKDDYSKRTMGLLVSDVGCIVWGATSAMC-TGWTK---ILFFLISLSYGMYTYFPHAAKVYIEAAF------<br>-HTVPKGI-CRELVRVMAWTFEVAWGMFPVLELLGTEGFGHISPYGSAIGHSILDLIAKNMWGVLGNYLRVKI---------HE---<br>HILLYGD-----IRKKQKITIA-GQEMEVETIVAEE |
| 280 | V2V1-61 | RSLIGSSYTNLNNGSIV-IPSD-ACFCMKWLKSKGSPVALKMANALQWAAFALSVILIYYAYATWRTTC--------GW-<br>EEVYVCCVELTKVVIEFFHEF--DEPGMLYLANGNRVLWL---<br>RYGEWLLTCPVLIHLSNLTGLKDDYNKRTMRLLVSDVGTIVWGATAAMS-TGYIK---VIFFLLGCMYGANTFFHAAKVYIESY------<br>-HTVPKGL-CRQLVRAMAWLFFVSWGMFPVLGPEGFGHLSVYGSTIGHSILDLIAKNMWGVLGNYLRVKI---------HE---<br>HILLYGD-----IRKKQKITIA-GQEMEVETIVAEE |
| 281 | V1V2-133 | ARSLIVRYPTDLGNGTVCMPRG-QCYCEGMLRSRGTSIEKTIAITLQWVVFALSVILIYYAYATWRTTC--------GW-<br>EEVYVCCVELTKVVIEFFHEF--DEPGMLYLANGNRVLWL---<br>RYGEWLLTCPVLIHLSNLTGLKDDYNKRTMRLLVSDVGTIVWGATAAMS-TGYIK---VIFFLLGCMYGANIFFHAAKVYIEAAF<br>-HTVPKGI-CRELVRVMAWTFEVAWGMFPVLELLGTEGFGHISPYGSAIGHSILDLIAKNMWGVLGNYLRVKI---------HE---<br>HILLYGD-----IRKKQKITIA-GQEMEVETIVAEE |

TABLE 4-continued

Alignment of truncated ChR sequences

| SEQ ID NO. | ChR name | Aligned amino acid sequence |
|---|---|---|
| 282 | VChR1 | ARSLIVRYPTDLGNGTVCMPRG-QCYCEGWLRSRGTSIEKTIAITLQWVFALSVACLGWYAYQAWRATC--------GW-EEVYVALIEMMKSIIEAFHEF--DSPATLWLSSGNGVVWM---RYGEWLLTCPVLLIHLSNLTGLKDDYSKRTMGLLVSDVGCIWWGATSAMC-TGWTK---ILFFLISLSYGMYTYFHAAKVYIEAF-------HTVPKGI-CRELVRVMAWTFEVAWGMFPVLELLGTEGFGHISPYGSAIGHSILDLIAKNMWGVLGNYLRVKI-----HE-HILLYGD-----IRKKQKITIA-GQEMEVETIVAEE |
| 283 | V1V2-223 | ARSLIVRYPTDLGNGTVCMPRG-QCYCEGWLRSRGTSIEKTIAITLQWVFALSVACLGWYAYQAWRATC--------GW-EEVYVALIEMMKSIIEAFHEF--DSPAMLYLANGNRVLWL---RYGEWLLTCPVILIHLSNLTGLKDDYNKRTMRLLVSDVGTIVWGATAAMS-TGYIK---ILFFLISLSYGMYTYFHAAKVYIEAF-------HTVPKGI-CRELVRVMAWTFEVAWGMFPVLELLGTEGFGHISPYGSAIGHSILDLIAKNMWGVLGNYLRVKI-----HE-HILLYGD-----IRKKQKITIA-GQEMEVETIVAEE |
| 284 | V1V2-421 | ARSLIVRYPTDLGNGTVCMPRG-QCYCEGWLRSRGTSIEKTIAITLQWVFALSVACLGWYAYQAWRATC--------GW-EEVYVALIEMMKSIIEAFHEF--DSPATLWLSSGNGVVWM---RYGEWLLTCPVLLIHLSNLTGLKDDYSKRTMGLLVSDVGCIVWGATSAMC-TGYIK---VIFFLLGCMYGANTFFHAAKVYIESY-------HTVPKGL-CRQLVRAMAWLFFVSWGMFPVLFLLGPEGFGHLSVYGSAIGHSILDLIAKNMWGVLGNYLRVKI-----HE-HILLYGD-----IRKKQKITIA-GQEMEVETIVAEE |
| 285 | V1V2-322 | ARSLIVRYPTDLGNGTVCMPRG-QCYCEGWLRSRGTSIEKTIAITLQWVFALSVACLGWYAYQAWRATC--------GW-EEVYVALIEMMKSIIEAFHEF--DSPATLWLSSGNGVVWM---RYGEWLLTCPVILIHLSNLTGLKDDYNKRTMRLLVSDVGTIVWGATAAMS-TGYIK---VIFFLLGCMYGANTFFHAAKVYIESF-------HTVPKGI-CRELVRVMAWTFEVAWGMFPVLELLGTEGFGHISPYGSAIGHSILDLIAKNMWGVLGNYLRVKI-----HE-HILLYGD-----IRKKQKITIA-GQEMEVETIVAEE |
| 286 | V1V2-52 | ARSLIVRYPTDLGNGTVCMPRG-QCYCEGWLRSRGTSIEKTIAITLQWVFALSVACLGWYAYQAWRATC--------GW-EEVYVALIEMMKSIIEAFHEF--DSPATLWLSSGNGVVWM---RYGEWLLTCPVLLIHLSNLTGLKDDYSKRTMGLLVSDVGCIVWGATSAMC-TGWTK---ILFFLISLSYGMYTYFHAAKVYIEAF-------HTVPKGI-CRELVRAMAWLFFVSWGMFPVLELLGPEGFGHLSVYGSTIGHTIIDLLSKNCWGLLGHFLRLKI-------HE-HILLYGD-----IRKVQKIRVA-GEELEVETLMTEE |
| 287 | V1V2-25 | ARSLIVRYPTDLGNGTVCMPRG-QCYCEGWLRSRGTSIEKTIAITLQWVFALSVACLGWYAYQAWRATC--------GW-EEVYVALIEMMKSIIEAFHEF--DSPATLWLSSGNGVVWM---RYGEWLLTCPVLLIHLSNLTGLKDDYSKRTMGLLVSDVGTIVWGATAAMS-TGYIK---VIFFLLGCMYGANTFFHAAKVYIESY-------HTVPKGL-CRQLVRAMAWLFFVSWGMFPVLELLGPEGFGHLSVYGSTIGHTIIDLLSKNCWGLLGHFLRLKI-------HE-HILLYGD-----IRKVQKIRVA-GEELEVETLMTEE |
| 288 | SFO_C128S | ELLEVINPVVNGS--VLVPED-QCYCAGWIESRGINGAQTASNVLQWLAAGFSILLLMFYAYQTWKSTC--------GW-EEIYVCAIEMVKVILEFFFEF--KNPSMLYLATGHRVQWL---RYAEWLLTSPVILIHLSNLTGLSNDYSRRTMGLLVSDIGTIVWGATSAMA-TGYVK---VIFFCLGLCYGANTFFHAAKAVIEGY-------HTVPKGR-CRQVVTGMAWLFFVSWGMFPILFILGPEGVLSVYGSTVGHTIIDLMSKNCWGLLGHYLRVLI-----HE-HILIHGD-----IRKTKLNIG-GTEIEVETIVEDE |

TABLE 4-continued

Alignment of truncated ChR sequences

| SEQ ID NO. | ChR name | Aligned amino acid sequence |
|---|---|---|
| 289 | CatCh | ELLFVTNPVVVNGS--VLVPED-QCYCAGWIESRGTNGAQTASNVLQWLAAGFSILLLMFYAYQTWKSTC--------GW-EEIYVCAIEMVKVILEFFFEF--KNPSMLYLATGHRVQWL---RYAEWLLTCPVICIHLSNLTGLSNDYSRRTMGLLVSDIGTIVWGATSAMA-TGYVK---VIFFCLGLCYGANTFFHAAKAYIEGY------HE--HTVPKGR-CRQVVTGMAWLFFVSWGMFPILFILGPEGFGVLSVYGSTVGHTIIDLMSKNCWGLLGHYLRVLI----------HILIHGD-----IRKTTKLNIG-GTEIEVETIVEDE |
| 290 | SFO_C128A | ELLFVTNPVVVNGS--VLVPED-QCYCAGWIESRGTNGAQTASNVLQWLAAGFSILLLMFYAYQTWKSTC--------GW-EEIYVCAIEMVKVILEFFFEF--KNPSMLYLATGHRVQWL---RYAEWLLTAPVILIHLSNLTGLSNDYSRRTMGLLVSDIGTIVWGATSAMA-TGYVK---VIFFCLGLCYGANTFFHAAKAYIEGY------HE--HTVPKGR-CRQVVTGMAWLFFVSWGMFPILFILGPEGFGVLSVYGSTVGHTIIDLMSKNCWGLLGHYLRVLI----------HILIHGD-----IRKTTKLNIG-GTEIEVETIVEDE |
| 291 | SFO_C128T | ELLFVTNPVVVNGS--VLVPED-QCYCAGWIESRGTNGAQTASNVLQWLAAGFSILLLMFYAYQTWKSTC--------GW-EEIYVCAIEMVKVILEFFFEF--KNPSMLYLATGHRVQWL---RYAEWLLTTPVILIHLSNLTGLSNDYSRRTMGLLVSDIGTIVWGATSAMA-TGYVK---VIFFCLGLCYGANTFFHAAKAYIEGY------HE--HTVPKGR-CRQVVTGMAWLFFVSWGMFPILFILGPEGFGVLSVYGSTVGHTIIDLMSKNCWGLLGHYLRVLI----------HILIHGD-----IRKTTKLNIG-GTEIEVETIVEDE |
| 292 | ChR2 | ELLFVTNPVVVNGS--VLVPED-QCYCAGWIESRGTNGAQTASNVLQWLAAGFSILLLMFYAYQTWKSTC--------GW-EEIYVCAIEMVKVILEFFFEF--KNPSMLYLATGHRVQWL---RYAEWLLTCPVILIHLSNLTGLSNDYSRRTMGLLVSDIGTIVWGATSAMA-TGYVK---VIFFCLGLCYGANTFFHAAKAYIEGY------HE--HTVPKGR-CRQVVTGMAWLFFVSWGMFPILFILGPEGFGVLSVYGSTVGHTIIDLMSKNCWGLLGHYLRVLI----------HILIHGD-----IRKTTKLNIG-GTEIEVETIVEDE |
| 293 | TC | ELLFVTNPVVVNGS--VLVPED-QCYCAGWIESRGTNGAQTASNVLQWLAAGFSILLLMFYAYQTWKSTC--------GW-EEIYVCAIEMVKVILEFFFEF--KNPSMLYLATGHRVQWL---RYAEWLLTCPVILIHLSNLTGLSNDYSRRTMGLLVSDIGCIVWGATSAMA-TGYVK---VIFFCLGLCYGANTFFHAAKAYIEGY------HE--HTVPKGR-CRQVVTGMAWLFFVSWGMFPILFILGPEGFGVLSVYGSTVGHTIIDLMSKNCWGLLGHYLRVLI----------HILIHGD-----IRKTTKLNIG-GTEIEVETIVEDE |
| 294 | ChETA_TC | ELLFVTNPVVVNGS--VLVPED-QCYCAGWIESRGTNGAQTASNVLQWLAAGFSILLLMFYAYQTWKSTC--------GW-EEIYVCAIEMVKVILEFFFEF--KNPSMLYLATGHRVQWL---RYATWLLTCPVILIHLSNLTGLSNDYSRRTMGLLVSDIGCIVWGATSAMA-TGYVK---VIFFCLGLCYGANTFFHAAKAYIEGY------HE--HTVPKGR-CRQVVTGMAWLFFVSWGMFPILFILGPEGFGVLSVYGSTVGHTIIDLMSKNCWGLLGHYLRVLI----------HILIHGD-----IRKTTKLNIG-GTEIEVETIVEDE |
| 295 | ChR2_R | ELLFVTNPVVVNGS--VLVPED-QCYCAGWIESRGTNGAQTASNVLQWLAAGFSILLLMFYAYQTWKSTC--------GW-EEIYVCAIEMVKVILEFFFEF--KNPSMLYLATGHRVQWL---RYAEWLLTCPVILIRLSNLTGLSNDYSRRTMGLLVSDIGTIVWGATSAMA-TGYVK---VIFFCLGLCYGANTFFHAAKAYIEGY------HE--HTVPKGR-CRQVVTGMAWLFFVSWGMFPILFILGPEGFGVLSVYGSTVGHTIIDLMSKNCWGLLGHYLRVLI----------HILIHGD-----IRKTTKLNIG-GTEIEVETIVEDE |

TABLE 4-continued

Alignment of truncated ChR sequences

| SEQ ID NO. | ChR name | Aligned amino acid sequence |
|---|---|---|
| 296 | ChETA_TR | ELLFVTNPVVNGS--VLVPED-QCYCAGWIESRGTNGAQTASNVLQWLAAGFSILLLMFYAYQTWKSTC-------GW-EEIYVCAIEMVKVILEFFFEF--KNPSMLYLATGHRVQWL---RYATWLLTCPVLIRLSNLTGLSNDYSRRTMGLLVSDIGTIVWGATSAMA-TGYVK---VIFFCLGLCYGANTFFHAAKAYIEGY-------HTVPKGR-CRQVVTGMAWLFFVSWGMFPPILFILGPEGFGVLSVYGSTVGHTIIDLMSKNCWGLLGHYLRVLI--------HE-HILIHGD-----IRKTTKLNIG-GTEIEVETIVEDE |
| 297 | ChETA_AR | ELLEVINPVVNGS--VLVPED-QCYCAGWIESRGINGAQTASNVLQWLAAGESILLLMFYAYQTWKSTC-------GW-EEIYVCAIEMVKVILEFFFEF--KNPSMLYLATGHRVQWL---RYAAWLLTCPVLIRLSNLTGLSNDYSRRTMGLLVSDIGTIVWGATSAMA-TGYVK---VIFFCLGLCYGANTFFHAAKAYIEGY-------HTVPKGR-CRQVVTGMAWLFFVSWGMFPPILFILGPEGFGVLSVYGSTVGHTIIDLMSKNCWGLLGHYLRVLI--------HE-HILIHGD-----IRKTTKLNIG-GTEIEVETIVEDE |
| 298 | ChETA_A | ELLEVINPVVNGS--VLVPED-QCYCAGWIESRGINGAQTASNVLQWLAAGESILLLMFYAYQTWKSTC-------GW-EEIYVCAIEMVKVILEFFFEF--KNPSMLYLATGHRVQWL---RYAEWLLTCPVLIHLSNLTGLSNDYSRRTMGLLVSDIGTIVWGATSAMA-TGYVK---VIFFCLGLCYGANTFFHAAKAYIEGY-------HTVPKGR-CRQVVTGMAWLFFVSWGMFPPILFILGPEGFGVLSVYGSTVGHTIIDLMSKNCWGLLGHYLRVLI--------HE-HILIHGD-----IRKTTKLNIG-GTEIEVETIVEDE |
| 299 | ChETA_T | ELLEVINPVVNGS--VLVPED-QCYCAGWIESRGINGAQTASNVLQWLAAGESILLLMFYAYQTWKSTC-------GW-EEIYVCAIEMVKVILEFFFEF--KNPSMLYLATGHRVQWL---RYATWLLTCPVLIHLSNLTGLSNDYSRRTMGLLVSDIGTIVWGATSAMA-TGYVK---VIFFCLGLCYGANTFFHAAKAYIEGY-------HTVPKGR-CRQVVTGMAWLFFVSWGMFPPILFILGPEGFGVLSVYGSTVGHTIIDLMSKNCWGLLGHYLRVLI--------HE-HILIHGD-----IRKTTKLNIG-GTEIEVETIVEDE |
| 300 | Abcdefg1 | RMLFQTSYTLENNGSVICIPNNGQCFCLAWLKSNGTNAEKLAANILQWITEALSALCLMFYGYQTWKSTC-------GW-EEIYVCAIEMVKVILEFFFEF--KNPSMLYLATGHRVQWL---RYAEWLLTCPVLIHLSNLTGLSNDYSRRTMGLLVSDIGTIVWGATSAMA-TGYVK---VIFFCLGLCYGANTFFHAAKAYIEGY-------HTVPKGR-CRQVVTGMAWLFFVSWGMFPIL ILGPEGFGVLSVYGSTVGHTIIDLMSKNCWGLLGHYLRVLI--------HE-HILIHGD-----IRKTTKLNIG-GTEIEVETIVEDE |
| 301 | ChR1 | RMLFQTSYTLENNGSVICIPNNGQCFCLAWLKSNGTNAEKLAANILQWITEALSALCLMFYGYQTWKSTC-------GW-EEIYVATIEMIKFIIEYFHEF--DEPAVIYSSNGNKTVWL---RYAEWLLTCPVLIHLSNLTGLANDYINKRTMGLLVSDIGTIVWGITAALS-KGYVR---VIFFLMGLCYGIYIFFNAAKVVIEAY-------HTVPKGI-CRDLVRYLAWLYFCSWAMFPVLFLLGPEGFGHINQFNSAIAHAILDLASKNAWSMMGHFLRVKI--------HE-HILLYGD-----IRKKQKVNVA-GQEMEVETMVHEE |
| 302 | ChR_f | RMLFQTSYTLENNGSVICIPNNGQCFCLAWLKSNGTNAEKLAANILQWITEALSALCLMFYGYQTWKSTC-------GW-EEIYVATIEMIKFIIEYFHEF--DEPAVIYSSNGNKTVWL---RYAEWLLTCPVLIHLSNLTGLANDYNKRTMGLLVSDIGTIVWGITAALS-KGYVR---VIFFLMGLCYGIYIFFNAAKVVIEAY-------HTVPKGR-CRQVVTGMAWLFFVSWGMFPPLFLLGPEGFGHINQFNSAIAHAILDLASKNAWSMMGHFLRVKI--------HE-HILLYGD-----IRKKQKVNVA-GQEMEVETMVHEE |

TABLE 4-continued

Alignment of truncated ChR sequences

| SEQ ID NO. | ChR name | Aligned amino acid sequence |
|---|---|---|
| 303 | GR | RMLFQTSYTLENNGSVICIPNNGQCFCLAWLKSNGTNAEKLAANILQWITFALSALCLMFGYQTWKSTC--------GW-EEIYVATIEMIKFIIEYFHEF--DEPAVIYSSNGNKTVWL---RYAEWLLTCPVLIHLSNLTGLANDYNKRTMGLLVSDIGTIVWGITAALS-KGYVR---VIFFLMGLCYGIYFFNAAKVYIEAY------HE---HTVPKGR-CRQVVTGMAWLFFVSWGMFPILFLLGPEGFGHINQFNSAIAHAILDLASKNCWGLLGHYLRVLI----------HILIHGD-----IRKTTKLNIG-GTEIEVETIVEDE |
| 304 | ABCDEFg6 | RMLFQTSYTLENNGSVICIPNNGQCFCLAWLKSNGTNAEKLAANILQWITEALSALCLMFGYQTWKSTC--------GW-EEIYVATIEMIKFIIEYFHEF--DEPAVIYSSNGNKTVWL---RYAEWLLTCPVLIHLSNLTGLANDYNKRTMGLLVSDIGTIVWGITAALS-KGYVR---VIFFLMGLCYGIYTFFNAAKVYIEAY------HE---HTVPKGI-CRDLVRYLAWLYFCSWAMPPVLELLGPEGEGVLSVYGSTVGHTIIDLMSKNCWGLLGHYLRVLI----------HILIHGD-----IRKTTKLNIG-GTEIEVETIVEDE |
| 305 | ChF | RMLFQTSYTLENNGSVICIPNNGQCFCLAWLKSNGTNAEKLAANILQWITFALSALCLMFGYQTWKSTC--------GW-EEIYVATIEMIKFIIEYFHEF--DEPAVIYSSNGNKTVWL---RYAEWLLTCPVLIHLSNLTGLANDYNKRTMGLLVSDIGTIVWGITAALS-KGYVR---VIFFLMGLCYGIYTFFNAAKVYIEAY------HE---HTVPKGI-CRDLVRYLAWLYFCSWAMFPPVLELLGPEGEGVLSVYGSTVGHTIIDLMSKNCWGLLGHYLRVLI----------HILIHGD-----IRKTTKLNIG-GTEIEVETIVEDE |
| 306 | ABCDEfg5 | RMLFQTSYTLENNGSVICIPNNGQCFCLAWLKSNGTNAEKLAANILQWITFALSALCLMFGYQTWKSTCGW-EEIYVATIEMIKFIIEYFHEF--DEPAVIYSSNGNKTVWL---RYAEWLLTCPVLIHLSNLTGLANDYNKRTMGLLVSDIGTIVWGITAALS-KGYVR---VIFFLMGLCYGIYTFFNAAKVYIEAY------HE---HTVPKGR-CRQVVTGMAWLFFVSWGMFPILFILGPEGFGVLSVYGSTVGHTIIDLMSKNCWGLLGHYLRVLI----------HILIHGDIRKTTKLNIG-GTEIEVETIVEDE |
| 307 | ChEF | RMLFQTSYTLENNGSVICIPNNGQCFCLAWLKSNGTNAEKLAANILQWITFALSALCLMFGYQTWKSTC--------GW-EEIYVATIEMIKFIIEYFHEF--DEPAVIYSSNGNKTVWL---RYAEWLLTCPVLIHLSNLTGLANDYNKRTMGLLVSDIGTIVWGITAALS-KGYVR---VIFFLMGLCYGIYTFFNAAKVYIEAY------HE---HTVPKGR-CRQVVTGMAWLFFVSWGMFPILFILGPEGFGVLSVYGSTVGHTIIDLMSKNCWGLLGHYLRVLI----------HILIHGD-----IRKTTKLNIG-GTEIEVETIVEDE |
| 308 | ChIEF | RMLFQTSYTLENNGSVICIPNNGQCFCLAWLKSNGTNAEKLAANILQWITFALSALCLMFGYQTWKSTC--------GW-EEIYVATIEMIKFIIEYFHEF--DEPAVIYSSNGNKTVWL---RYAEWLLTCPVLIHLSNLTGLANDYNKRTMGLLVSDIGTIVWGITAALS-KGYVR---VIFFLMGLCYGIYTFFNAAKVYIEAY------HE---HTVPKGR-CRQVVTGMAWLFFVSWGMFPILFILGPEGFGVLSVYGSTVGHTIIDLMSKNCWGLLGHYLRVLI----------HILIHGD-----IRKTTKLNIG-GTEIEVETIVEDE |
| 309 | ABCDefg4 | RMLFQTSYTLENNGSVICIPNNGQCFCLAWLKSNGTNAEKLAANILQWITFALSALCLMFGYQTWKSTC--------GW-EEIYVATIEMIKFIIEYFHEF--DEPAVIYSSNGNKTVWL---RYAEWLLTCPVLIHLSNLTGLANDYNKRTMGLLVSDIGTIVWGITAALS-KGYVK---VIFFCLGLCYGANTFFHAAKAVIEGY------HE---HTVPKGR-CRQVVTGMAWLFFVSWGMFPILFILGPEGFGVLSVYGSTVGHTIIDLMSKNCWGLLGHYLRVLI----------HILIHGD-----IRKTTKLNIG-GTEIEVETIVEDE |

TABLE 4-continued

Alignment of truncated ChR sequences

| SEQ ID NO. | ChR name | Aligned amino acid sequence |
|---|---|---|
| 310 | ChD | RMLFQTSYTLENNGSVICIPNNGQCFCLAWLKSNGTNAEKLAANILQWITFALSALCLMFYGYQTWKSTC--------GW-EEIYVATIEMIKFIIEYFHEF--DEPAVIYSSNGNKTVWL---RYAEWLLTCPVLIHLSNLTGLANDYNKRTMGLLVSDIGTIVWGATSAMA-TGYVK---VIFFCLGLCYGANTFFHAAKAYIEGY-----HTVPKGR-CRQVVTGMAWLFFVSWGMFPPILFILGPEGFGVLSVYGSTVGHTIIDLMSKNCWGLLGHYLRVLI-------HE-HILIHGD-----IRKTTKLNIG-GTEIEVETIVEDE |
| 311 | ABCdefg2 | RMLFQTSYTLENNGSVICIPNNGQCFCLAWLKSNGTNAEKLAANILQWITFALSALCLMFYGYQTWKSTC--------GW-EEIYVATIEMIKFIIEYFHEF--DEPAVIYSSNGNKTVWL---RYAEWLLTCPVLIHLSNLTGLSNDYSRRTMGLLVSDITIVWGATSAMA-TGYVK---VIFFCLGLCYGANTFFHAAKAYIEGY-----HTVPKGR-CRQVVTGMAWLFFVSWGMFPPILFILGPEGFGVLSVYGSTVGHTIIDLMSKNCWGLLGHYLRVLI-------HE-HILIHGD-----IRKTTKLNIG-GTEIEVETIVEDE |
| 312 | ABCdefg3 | RMLFQTSYTLENNGSVICIPNNGQCFCLAWLKSNGTNAEKLAANILQWITFALSALCLMFYGYQTWKSTC--------GW-EEIYVATIEMIKFIIEYFHEF--DEPAVIYSSNGNKTVWL---RYAEWLLTCPVLIHLSNLTGLANDYSRRTMGLLVSDIGTIVWGATSAMA-TGYVK---VIFFCLGLCYGANTFFHAAKAYIEGY-----HTVPKGR-CRQVVTGMAWLFFVSWGMFPPILFILGPEGFGVLSVYGSTVGHTIIDLMSKNCWGLLGHYLRVLI-------HE-HILIHGD-----IRKTTKLNIG-GTEIEVETIVEDE |
| 313 | C1V1-52 | RMLFQTSYTLENNGSVICIPNNGQCFCLAWLKSNGTNAEKLAANILQWITFALSALCLMFYGYQTWKSTC--------GW-EEIYVATIEMIKFIIEYFHEF--DEPAVIYSSNGNKTVWL---RYAEWLLTCPVLIHLSNLTGLANDYNKRTMGLLVSDIGTIVWGTTAALS-KGYVR---VIFFLMGLCYGIYTFFNAAKVYIEAY-----HTVPKGI-CRDLVRVMAWTFEVAWGMFPVLELLGTEGFGHISPYGSAIGHSILDLIAKNMWGVLGNYLRVKI-------HE-HILLYGD-----IRKKQKITIA-GQEMEVETIVAEE |
| 314 | C_VChR1 | RMLFQTSYTLENNGSVICIPNNGQCFCLAWLKSNGTNAEKLAANILQWITFALSALCLMFYGYQTWKSTC--------GW-EEVYVALIEMMKSIIEAFHEF--DSPATLWLSSGNGVVWM---RYGEWLLTCPVLIHLSNLTGLKDDYSKRTMGLLVSDVGCIVWGATSAMC-TGWTK---ILFFLISLSYGMYTYFHAAKVVIEAF-----HTVPKGI-CRELVRVMAWTFEVAWGMFPVLELLGTEGFGHISPYGSAIGHSILDLIAKNMWGVLGNYLRVKI-------HE-HILLYGD-----IRKKQKITIA-GQEMEVETIVAEE |
| 315 | bReaChES | VGLFQTSYTLENNGSVICIPNNGQCFCLAWLKSNGTNAEKLAANILQWVVFALSVACLGWYAYQAWRATC--------GW-EEVYVALIEMMKSIIERAFHEF--DSPATLWLSSGNGVVWM---RYGSWLLTCPVLIHLSNLTGLKDDYSKRTMGLLVSDVGCIVWGATSAMC-TGWTK---ILFFLISLSYGMYTYFHAAKVVIEAF-----HTVPKGL-CRQLVRAMAWLFFVSWGMFPVLFLLGPEGFGHISPYGSAIGHSILDLIAKNMWGVLGNYLRVKI-------HE-HILLYGD-----IRKKQKITIA-GQEMEVETIVAEE |
| 316 | ReaChR | RMLFQTSYTLENNGSVICIPNNGQCFCLAWLKSNGTNAEKLAANILQWVVFALSVACLGWYAYQAWRATC--------GW-EEVYVALIEMMKSIIERAFHEF--DSPATLWLSSGNGVVWM---RYGEWLLTCPVLIHLSNLTGLKDDYSKRTMGLLVSDVGCIVWGATSAMC-TGWTK---ILFFLISLSYGMYTYFHAAKVVIEAF-----HTVPKGL-CRQLVRAMAWLFFVSWGMFPVLFLLGPEGFGHISPYGSAIGHSILDLIAKNMWGVLGNYLRVKI-------HE-HILLYGD-----IRKKQKITIA-GQEMEVETIVAEE |

TABLE 4-continued

Alignment of truncated ChR sequences

| SEQ ID NO. | ChR name | Aligned amino acid sequence |
|---|---|---|
| 317 | VCOMET | RMLFQTSYTLENNGSVICIPNNGQCFCLAWLKSNGTNAEKLAANILQWVVFALSVACLGWVAYQAWRATC-------GW-EEVYVALIEMMKSIIEAFHEF--DSPATLWLSSGNGVVWM---RYGEWLLTCPVLLIHLSNLTGLKDDYSKRTMGLLVSDVGCIVWGATSAMC-TGWTK---ILFFLISLSYGMYTYFHAAKVYIEAF-------HTVPKGL-CRQLVRAMAWLFFVSWGMFPVLFLLGPEGFGHISPYGSAIGHSILDLIAKNMWGVLGNYLRVKI--------HE HILLYGD-----IRKKQKITIA-GQEMEVETIVAEE |
| 318 | C1V1_T1 | RMLFQTSYTLENNGSVICIPNNGQCFCLAWLKSNGTNAEKLAANILQWITFALSALCLMFYGYQTWKSTC-------GW-ETIYVATIEMIKFIIEYFHEF--DEPAVIYSSNGNKTVWL---RYAEWLLTCPVLLIHLSNLTGLKDDYSKRTMGLLVSDVGCIVWGATSAMC-TGWTK---ILFFLISLSYGMYTYFHAAKVYIEAF-------HTVPKGI-CRELVRVMAWTFEVAWGMFPVLELLGTEGFGHISPYGSAIGHSILDLIAKNMWGVLGNYLRVKI--------HE HILLYGD-----IRKKQKITIA-GQEMEVETIVAEE |
| 319 | C1V1 | RMLFQTSYTLENNGSVICIPNNGQCFCLAWLKSNGTNAEKLAANILQWITFALSALCLMFYGYQTWKSTC-------GW-EEIYVATIEMIKFIIEYFHEF--DEPAVIYSSNGNKTVWL---RYAEWLLTCPVLLIHLSNLTGLKDDYSKRTMGLLVSDVGCIVWGATSAMC-TGWTK---ILFFLISLSYGMYTYFHAAKVYIEAF-------HTVPKGI-CRELVRVMAWIFFVAWGMFPVLFLLGTEGFGHISPYGSAIGHSILDLIAKNMWGVLGNYLRVKI--------HE HILLYGD-----IRKKQKITIA-GQEMEVETIVAEE |
| 320 | C1V1_TT | RMLFQTSYTLENNGSVICIPNNGQCFCLAWLKSNGTNAEKLAANILQWITFALSALCLMFYGYQTWKSTC-------GW-ETIYVATIEMIKFIIEYFHEF--DEPAVIYSSNGNKTVWL---RYATWLLTCPVLLIHLSNLIGLKDDYSKRTMGLLVSDVGCIWGATSAMC-TGWIK---ILFFLISLSYGMYTYFHAAKVYIEAF-------HTVPKGI-CRELVRVMAWIFFVAWGMFPVLFLLGTEGFGHISPYGSAIGHSILDLIAKNMWGVLGNYLRVKI--------HE HILLYGD-----IRKKQKITIA-GQEMEVETIVAEE |
| 321 | C1V1_T2 | RMLFQTSYTLENNGSVICIPNNGQCFCLAWLKSNGTNAEKLAANILQWITFALSALCLMFYGYQTWKSTC-------GW-EEIYVATIEMIKFIIEYFHEF--DEPAVIYSSNGNKTVWL---RYATWLLTCPVLLIHLSNLIGLKDDYSKRTMGLLVSDVGCIVWGATSAMC-TGWIK---ILFFLISLSYGMYTYFHAAKVYIEAF-------HTVPKGI-CRELVRVMAWIFFVAWGMFPVLFLLGTEGFGHISPYGSAIGHSILDLIAKNMWGVLGNYLRVKI--------HE HILLYGD-----IRKKQKITIA-GQEMEVETIVAEE |

Dataset 2 (shown in Tables 1 and 2). ChR variant sequences and functional properties for designed variants from our recombination libraries. Functional properties were tested in HEK cells. Measurements of peak and steady-state photocurrent (nA) with 481 nm light at 2.3 mW mm$^{-2}$ ("cyan_peak" & "cyan_ss"), 546 nm light at 2.8 mW mm$^{-2}$ ("green_peak" & "green_ss"), and 640 nm light at 2.2 mW mm$^{-2}$ ("red_peak" & "red_ss") are included. The maximum peak ("max_peak") and maximum steady-state ("max_ss") photocurrent (nA) obtained with any wavelength are included. Measurement of the time (ms) to reach 50% of the light-exposed photocurrent after light removal is included ("kinetics_off"). The ratio of peak photocurrent with 546 nm light to maximum photocurrent was calculated per each cell and average for each ChR variant ("norm_green"). Off-kinetics ("kinetics_off") and spectral properties ("norm_green") were only included for ChR variants with steady-state photocurrent strength >0.02 nA. Each ChR recombination variant has a chimera identity ("block_ID") beginning with either 'c' or 'n' to indicate the contiguous or non-contiguous library followed by 10 digits indicating the parent that contributes each of the 10 blocks ('0': CheRiff, '1':C1C2, and '2':CsChrimR). Each ChR variant's number of mutations away from the nearest parent ('m') is included. For modeling, all sequences were aligned and truncated to match the length of the C1C2 sequence. The truncated and aligned sequences are included ("Aligned_amino_acid_sequence") as well as the full-length sequence ("Amino_acid_sequence"). Full sequences of non-limiting examples of ChR proteins listed in Table 1 are provided in SEQ ID NOs: 1-154, and the respective truncated and aligned sequences for those ChR proteins are provided in SEQ ID NOs: 322-475.

Dataset 3. ChR variants predicted to localize and function. 1,161 ChR variants from the recombination libraries are above the 0.4 threshold for the product ('pp') of the predicted probabilities of localization ('p_loc') and function ('p_func'). For all remaining variants (i.e., variants not yet measured), the regression models' prediction of peak photocurrent in nA ('mu_peak_nA'), off-kinetics (time [ms] to reach 50% of the light-exposed photocurrent after light removal; 'mu_kin_ms'), and normalized photocurrent with 546 nm light ('mu_green') were included. ChR variants' amino acid and nucleic acid sequences were also included.

Dataset 4 (shown in Table 5). Limited set of amino acid residues and structural contacts important for model predictions identified with L1-regularized linear regression. The relative importance ('weight') of these sequence and structural features is learned using Bayesian ridge regression. A different limited set of features was found for each of the three functional properties of interest ('norm_green', 'off_kinetics', and 'peak_photocurrent'). Features are either amino acid residues (i.e. a sequence feature ['seq']) or contacts. The feature position is indicated with numbering according to the aligned and truncated ChR sequence. The parental features were included at each position with numbering according the parental sequence. Highly-weighted features highlighted in color in FIGS. 8A-D are indicated by their corresponding color. Features not highlighted in FIGS. 8A-D are listed as gray.

TABLE 5

Limited set of amino acid residues and structural contacts important for model predictions identified with L1-regularized linear regression

| feature | weights | types | groups | feature_C1C2_adjust | feature_CheRiff_adjust | feature_CsChrim_adjust | color | property |
| --- | --- | --- | --- | --- | --- | --- | --- | --- |
| ['D161', 'T197'] | −0.047700148 | contact | 3 | ['D195', 'T227'] | ['D220', 'T252'] | ['C193', 'M225'] | gray | norm_green |
| ['T164', 'T197'] | −0.047700148 | contact | 3 | ['T198', 'T227'] | ['T223', 'T252'] | ['M196', 'M225'] | gray | norm_green |
| ['T164', 'G190'] | −0.099968892 | contact | 14 | ['T198', 'G220'] | ['T223', 'G245'] | ['M196', 'S218'] | skyblue | norm_green |
| ['T170', 'F186'] | −0.099968892 | contact | 14 | ['T204', 'F216'] | ['T229', 'F241'] | ['A202', 'L214'] | skyblue | norm_green |
| ['A172', 'F247'] | −0.22555191 | contact | 16 | ['A206', 'F269'] | ['A231', 'F294'] | ['G204', 'W267'] | skyblue | norm_green |
| ['L158', 'D161'] | −0.106229081 | contact | 2 | ['L192', 'D195'] | ['L217', 'D220'] | ['I190', 'C193'] | skyblue | norm_green |
| L158 | −0.014052219 | seq | 11 | L192 | L217 | I190 | gray | norm_green |
| ['P134', 'L158'] | −0.014052219 | contact | 11 | ['P168', 'L192'] | ['P193', 'L217'] | ['P166', 'I190'] | gray | norm_green |
| ['L137', 'L158'] | −0.014052219 | contact | 11 | ['L171', 'L192'] | ['L196', 'L217'] | ['L169', 'I190'] | gray | norm_green |
| ['I138', 'L158'] | −0.014052219 | contact | 11 | ['I172', 'L192'] | ['I197', 'L217'] | ['I170', 'I190'] | gray | norm_green |
| ['T154', 'L158'] | −0.014052219 | contact | 11 | ['T188', 'L192'] | ['T213', 'L217'] | ['T186', 'I190'] | gray | norm_green |
| ['M155', 'L158'] | −0.014052219 | contact | 11 | ['M189', 'L192'] | ['M214', 'L217'] | ['M187', 'I190'] | gray | norm_green |
| ['L157', 'L158'] | −0.014052219 | contact | 11 | ['L191', 'L192'] | ['L216', 'L217'] | ['L189', 'I190'] | gray | norm_green |
| ['L158', 'V159'] | −0.014052219 | contact | 11 | ['L192', 'V193'] | ['L217', 'V218'] | ['I190', 'V191'] | gray | norm_green |
| ['L158', 'S160'] | −0.014052219 | contact | 11 | ['L192', 'S194'] | ['L217', 'S219'] | ['I190', 'S192'] | gray | norm_green |
| G177 | −0.001155787 | seq | 9 | G210 | G235 | D208 | gray | norm_green |
| V179 | −0.001155787 | seq | 9 | V212 | V237 | L210 | gray | norm_green |
| F186 | −0.001155787 | seq | 9 | F216 | F241 | L214 | gray | norm_green |
| G190 | −0.001155787 | seq | 9 | G220 | G245 | S218 | gray | norm_green |
| L191 | −0.001155787 | seq | 9 | L221 | L246 | C219 | gray | norm_green |
| ['A171', 'F186'] | −0.001155787 | contact | 9 | ['A205', 'F216'] | ['A230', 'F241'] | ['A203', 'L214'] | gray | norm_green |

TABLE 5-continued

Limited set of amino acid residues and structural contacts important for model predictions identified with L1-regularized linear regression

| feature | weights | types | groups | feature_C1C2_adjust | feature_CheRiff_adjust | feature_CsChrim_adjust | color | property |
|---|---|---|---|---|---|---|---|---|
| ['G177', 'V179'] | −0.001155787 | contact | 9 | ['G210', 'V212'] | ['G235', 'V237'] | ['D208', 'L210'] | gray | norm_green |
| ['V179', 'F186'] | −0.001155787 | contact | 9 | ['V212', 'F216'] | ['V237', 'F241'] | ['L210', 'L214'] | gray | norm_green |
| ['F186', 'G190'] | −0.001155787 | contact | 9 | ['F216', 'G220'] | ['F241', 'G245'] | ['L214', 'S218'] | gray | norm_green |
| ['G190', 'L191'] | −0.001155787 | contact | 9 | ['G220', 'L221'] | ['G245', 'L246'] | ['S218', 'C219'] | gray | norm_green |
| ['G190', 'Y193'] | −0.001155787 | contact | 9 | ['G220', 'Y223'] | ['G245', 'Y248'] | ['S218', 'Y221'] | gray | norm_green |
| ['G190', 'G194'] | 0.001155787 | contact | 9 | ['G220', 'G224'] | ['G245', 'G249'] | ['S218', 'G222'] | gray | norm_green |
| ['L191', 'Y193'] | 0.001155787 | contact | 9 | ['L221', 'Y223'] | ['L246', 'Y248'] | ['C219', 'Y221'] | gray | norm_green |
| ['L191', 'G194'] | 0.001155787 | contact | 9 | ['L221', 'G224'] | ['L246', 'G249'] | ['C219', 'G222'] | gray | norm_green |
| D177 | 0.001155787 | seq | 19 | G210 | G235 | D208 | gray | norm_green |
| L179 | 0.001155787 | seq | 19 | V212 | V237 | L210 | gray | norm_green |
| L186 | 0.001155787 | seq | 19 | F216 | F241 | L214 | gray | norm_green |
| I188 | 0.001155787 | seq | 19 | L218 | C243 | I216 | gray | norm_green |
| V189 | 0.001155787 | seq | 19 | M219 | I244 | V217 | gray | norm_green |
| S190 | 0.001155787 | seq | 19 | G220 | G245 | S218 | gray | norm_green |
| C191 | 0.001155787 | seq | 19 | L221 | L246 | C219 | gray | norm_green |
| I192 | 0.001155787 | seq | 19 | C222 | V247 | I220 | gray | norm_green |
| ['A171', 'L186'] | 0.001155787 | contact | 19 | ['A205', 'F216'] | ['A230', 'F241'] | ['A203', 'L214'] | gray | norm_green |
| ['A174', 'L179'] | 0.001155787 | contact | 19 | ['S208', 'F212'] | ['A233', 'V237'] | ['A206', 'L210'] | gray | norm_green |
| ['A174', 'L186'] | 0.001155787 | contact | 19 | ['S208', 'F216'] | ['A233', 'F241'] | ['A206', 'L214'] | gray | norm_green |
| ['T176', 'D177'] | 0.001155787 | contact | 19 | ['K209', 'G210'] | ['T234', 'G235'] | ['T207', 'D208'] | gray | norm_green |
| ['T176', 'L179'] | 0.001155787 | contact | 19 | ['K209', 'V212'] | ['T234', 'V237'] | ['T207', 'L210'] | gray | norm_green |
| ['D177', 'W178'] | 0.001155787 | contact | 19 | ['G210', 'Y211'] | ['G235', 'W236'] | ['D208', 'W209'] | gray | norm_green |
| ['D177', 'L179'] | 0.001155787 | contact | 19 | ['G210', 'V212'] | ['G235', 'V237'] | ['D208', 'L210'] | gray | norm_green |
| ['D177', 'K180'] | 0.001155787 | contact | 19 | ['G210', 'R213'] | ['G235', 'K238'] | ['D208', 'K211'] | gray | norm_green |
| ['D177', 'W184'] | 0.001155787 | contact | 19 | ['G210', 'V214'] | ['G235', 'W239'] | ['D208', 'W212'] | gray | norm_green |
| ['W178', 'L179'] | 0.001155787 | contact | 19 | ['Y211', 'V212'] | ['W236', 'V237'] | ['W209', 'L210'] | gray | norm_green |
| ['L179', 'K180'] | 0.001155787 | contact | 19 | ['V212', 'R213'] | ['V237', 'K238'] | ['L210', 'K211'] | gray | norm_green |
| ['L179', 'W184'] | 0.001155787 | contact | 19 | ['V212', 'V214'] | ['V237', 'W239'] | ['L210', 'W212'] | gray | norm_green |
| ['L179', 'L185'] | 0.001155787 | contact | 19 | ['V212', 'I215'] | ['V237', 'L240'] | ['L210', 'L213'] | gray | norm_green |
| ['L179', 'L186'] | 0.001155787 | contact | 19 | ['V212', 'F216'] | ['V237', 'F241'] | ['L210', 'L214'] | gray | norm_green |
| ['K180', 'L186'] | 0.001155787 | contact | 19 | ['R213', 'F216'] | ['K238', 'F241'] | ['K211', 'L214'] | gray | norm_green |
| ['W184', 'L186'] | 0.001155787 | contact | 19 | ['V214', 'F216'] | ['W239', 'F241'] | ['W212', 'L214'] | gray | norm_green |
| ['W184', 'I188'] | 0.001155787 | contact | 19 | ['V214', 'L218'] | ['W239', 'C243'] | ['W212', 'I216'] | gray | norm_green |
| ['L185', 'L186'] | 0.001155787 | contact | 19 | ['I215', 'F216'] | ['L240', 'F241'] | ['L213', 'L214'] | gray | norm_green |
| ['L185', 'I188'] | 0.001155787 | contact | 19 | ['I215', 'L218'] | ['L240', 'C243'] | ['L213', 'I216'] | gray | norm_green |
| ['L185', 'V189'] | 0.001155787 | contact | 19 | ['I215', 'M219'] | ['L240', 'I244'] | ['L213', 'V217'] | gray | norm_green |
| ['L186', 'Y187'] | 0.001155787 | contact | 19 | ['F216', 'F217'] | ['F241', 'Y242'] | ['L214', 'Y215'] | gray | norm_green |
| ['L186', 'I188'] | 0.001155787 | contact | 19 | ['F216', 'L218'] | ['F241', 'C243'] | ['L214', 'I216'] | gray | norm_green |
| ['L186', 'V189'] | 0.001155787 | contact | 19 | ['F216', 'M219'] | ['F241', 'I244'] | ['L214', 'V217'] | gray | norm_green |
| ['L186', 'S190'] | 0.001155787 | contact | 19 | ['F216', 'G220'] | ['F241', 'G245'] | ['L214', 'S218'] | gray | norm_green |
| ['Y187', 'I188'] | 0.001155787 | contact | 19 | ['F217', 'L218'] | ['Y242', 'C243'] | ['Y215', 'I216'] | gray | norm_green |

TABLE 5-continued

Limited set of amino acid residues and structural contacts important for model predictions identified with L1-regularized linear regression

| feature | weights | types | groups | feature_C1C2_adjust | feature_CheRiff_adjust | feature_CsChrim_adjust | color | property |
|---|---|---|---|---|---|---|---|---|
| ['Y187', 'V189'] | 0.001155787 | contact | 19 | ['F217', 'M219'] | ['Y242', 'I244'] | ['Y215', 'V217'] | gray | norm_green |
| ['Y187', 'S190'] | 0.001155787 | contact | 19 | ['F217', 'G220'] | ['Y242', 'G245'] | ['Y215', 'S218'] | gray | norm_green |
| ['Y187', 'C191'] | 0.001155787 | contact | 19 | ['F217', 'L221'] | ['Y242', 'L246'] | ['Y215', 'C219'] | gray | norm_green |
| ['I188', 'V189'] | 0.001155787 | contact | 19 | ['L218', 'M219'] | ['C243', 'I244'] | ['I216', 'V217'] | gray | norm_green |
| ['I188', 'S190'] | 0.001155787 | contact | 19 | ['L218', 'G220'] | ['C243', 'G245'] | ['I216', 'S218'] | gray | norm_green |
| ['I188', 'C191'] | 0.001155787 | contact | 19 | ['L218', 'L221'] | ['C243', 'L246'] | ['I216', 'C219'] | gray | norm_green |
| ['I188', 'I192'] | 0.001155787 | contact | 19 | ['L218', 'C222'] | ['C243', 'V247'] | ['I216', 'I220'] | gray | norm_green |
| ['V189', 'S190'] | 0.001155787 | contact | 19 | ['M219', 'G220'] | ['I244', 'G245'] | ['V217', 'S218'] | gray | norm_green |
| ['V189', 'C191'] | 0.001155787 | contact | 19 | ['M219', 'L221'] | ['I244', 'L246'] | ['V217', 'C219'] | gray | norm_green |
| ['V189', 'I192'] | 0.001155787 | contact | 19 | ['M219', 'C222'] | ['I244', 'V247'] | ['V217', 'I220'] | gray | norm_green |
| ['V189', 'Y193'] | 0.001155787 | contact | 19 | ['M219', 'Y223'] | ['I244', 'Y248'] | ['V217', 'Y221'] | gray | norm_green |
| ['S190', 'C191'] | 0.001155787 | contact | 19 | ['G220', 'L221'] | ['G245', 'L246'] | ['S218', 'C219'] | gray | norm_green |
| ['S190', 'I192'] | 0.001155787 | contact | 19 | ['G220', 'C222'] | ['G245', 'V247'] | ['S218', 'I220'] | gray | norm_green |
| ['S190', 'Y193'] | 0.001155787 | contact | 19 | ['G220', 'Y223'] | ['G245', 'Y248'] | ['S218', 'Y221'] | gray | norm_green |
| ['S190', 'G194'] | 0.001155787 | contact | 19 | ['G220', 'G224'] | ['G245', 'G249'] | ['S218', 'G222'] | gray | norm_green |
| ['C191', 'I192'] | 0.001155787 | contact | 19 | ['L221', 'C222'] | ['L246', 'V247'] | ['C219', 'I220'] | gray | norm_green |
| ['C191', 'Y193'] | 0.001155787 | contact | 19 | ['L221', 'Y223'] | ['L246', 'Y248'] | ['C219', 'Y221'] | gray | norm_green |
| ['C191', 'G194'] | 0.001155787 | contact | 19 | ['L221', 'G224'] | ['L246', 'G249'] | ['C219', 'G222'] | gray | norm_green |
| ['I192', 'Y193'] | 0.001155787 | contact | 19 | ['C222', 'Y223'] | ['V247', 'Y248'] | ['I220', 'Y221'] | gray | norm_green |
| ['I192', 'G194'] | 0.001155787 | contact | 19 | ['C222', 'G224'] | ['V247', 'G249'] | ['I220', 'G222'] | gray | norm_green |
| ['F167', 'Y187'] | 0.083751234 | contact | 10 | ['W201', 'F217'] | ['M226', 'Y242'] | ['F199', 'Y215'] | pink | norm_green |
| ['A170', 'A174'] | 0.083751234 | contact | 10 | ['T204', 'S208'] | ['T229', 'A233'] | ['A202', 'A206'] | pink | norm_green |
| ['G172', 'A174'] | 0.083751234 | contact | 10 | ['A206', 'S208'] | ['A231', 'A233'] | ['G204', 'A206'] | pink | norm_green |
| ['G172', 'K180'] | 0.083751234 | contact | 10 | ['A206', 'R213'] | ['A231', 'K238'] | ['G204', 'K211'] | pink | norm_green |
| ['G202', 'Y237'] | −0.456801278 | contact | 17 | ['A232', 'F259'] | ['G257', 'Y284'] | ['A230', 'F257'] | skyblue | norm_green |
| ['C192', 'I195'] | −0.339700103 | contact | 0 | ['C222', 'I225'] | ['V247', 'T250'] | ['I220', 'G223'] | skyblue | norm_green |
| P36 | 0.002608094 | seq | 8 | N85 | L110 | P83 | gray | norm_green |
| G37 | 0.002608094 | seq | 8 | A86 | W111 | G84 | gray | norm_green |
| I40 | 0.002608094 | seq | 8 | L89 | E114 | I87 | gray | norm_green |
| G41 | 0.002608094 | seq | 8 | A90 | T115 | G88 | gray | norm_green |
| Q43 | 0.002608094 | seq | 8 | N92 | R117 | Q90 | gray | norm_green |
| V44 | 0.002608094 | seq | 8 | I93 | G118 | V91 | gray | norm_green |
| C45 | 0.002608094 | seq | 8 | L94 | F119 | C92 | gray | norm_green |
| ['G34', 'P36'] | 0.002608094 | contact | 8 | ['G83', 'N85'] | ['G108', 'L110'] | ['G81', 'P83'] | gray | norm_green |
| ['T35', 'P36'] | 0.002608094 | contact | 8 | ['T84', 'N85'] | ['A109', 'L110'] | ['T82', 'P83'] | gray | norm_green |
| ['T35', 'G37'] | 0.002608094 | contact | 8 | ['T84', 'A86'] | ['A109', 'W111'] | ['T82', 'G84'] | gray | norm_green |
| ['P36', 'G37'] | 0.002608094 | contact | 8 | ['N85', 'A86'] | ['L110', 'W111'] | ['P83', 'G84'] | gray | norm_green |
| ['P36', 'E38'] | 0.002608094 | contact | 8 | ['N85', 'E87'] | ['L110', 'E112'] | ['P83', 'E85'] | gray | norm_green |
| ['P36', 'K39'] | 0.002608094 | contact | 8 | ['N85', 'K88'] | ['L110', 'Q113'] | ['P83', 'K86'] | gray | norm_green |
| ['P36', 'I40'] | 0.002608094 | contact | 8 | ['N85', 'L89'] | ['L110', 'E114'] | ['P83', 'I87'] | gray | norm_green |
| ['G37', 'E38'] | 0.002608094 | contact | 8 | ['A86', 'E87'] | ['W111', 'E112'] | ['G84', 'E85'] | gray | norm_green |

TABLE 5-continued

Limited set of amino acid residues and structural contacts important for model predictions identified with L1-regularized linear regression

| feature | weights | types | groups | feature_C1C2_adjust | feature_CheRiff_adjust | feature_CsChrim_adjust | color | property |
|---|---|---|---|---|---|---|---|---|
| ['G37', 'K39'] | 0.002608094 | contact | 8 | ['A86', 'K88'] | ['W111', 'Q113'] | ['G84', 'K86'] | gray | norm_green |
| ['G37', 'I40'] | 0.002608094 | contact | 8 | ['A86', 'L89'] | ['W111', 'E114'] | ['G84', 'I87'] | gray | norm_green |
| ['G37', 'G41'] | 0.002608094 | contact | 8 | ['A86', 'A90'] | ['W111', 'T115'] | ['G84', 'G88'] | gray | norm_green |
| ['E38', 'I40'] | 0.002608094 | contact | 8 | ['E87', 'L89'] | ['E112', 'E114'] | ['E85', 'I87'] | gray | norm_green |
| ['E38', 'G41'] | 0.002608094 | contact | 8 | ['E87', 'A90'] | ['E112', 'T115'] | ['E85', 'G88'] | gray | norm_green |
| ['K39', 'I40'] | 0.002608094 | contact | 8 | ['K88', 'L89'] | ['Q113', 'E114'] | ['K86', 'I87'] | gray | norm_green |
| ['K39', 'G41'] | 0.002608094 | contact | 8 | ['K88', 'A90'] | ['Q113', 'T115'] | ['K86', 'G88'] | gray | norm_green |
| ['K39', 'Q43'] | 0.002608094 | contact | 8 | ['K88', 'N92'] | ['Q113', 'R117'] | ['K86', 'Q90'] | gray | norm_green |
| ['I40', 'G41'] | 0.002608094 | contact | 8 | ['L89', 'A90'] | ['E114', 'T115'] | ['I87', 'G88'] | gray | norm_green |
| ['I40', 'A42'] | 0.002608094 | contact | 8 | ['L89', 'A91'] | ['E114', 'A116'] | ['I87', 'A89'] | gray | norm_green |
| ['I40', 'Q43'] | 0.002608094 | contact | 8 | ['L89', 'N92'] | ['E114', 'R117'] | ['I87', 'Q90'] | gray | norm_green |
| ['I40', 'V44'] | 0.002608094 | contact | 8 | ['L89', 'I93'] | ['E114', 'G118'] | ['I87', 'V91'] | gray | norm_green |
| ['G41', 'A42'] | 0.002608094 | contact | 8 | ['A90', 'A91'] | ['T115', 'A116'] | ['G88', 'A89'] | gray | norm_green |
| ['G41', 'Q43'] | 0.002608094 | contact | 8 | ['A90', 'N92'] | ['T115', 'R117'] | ['G88', 'Q90'] | gray | norm_green |
| ['G41', 'V44'] | 0.002608094 | contact | 8 | ['A90', 'I93'] | ['T115', 'G118'] | ['G88', 'V91'] | gray | norm_green |
| ['G41', 'C45'] | 0.002608094 | contact | 8 | ['A90', 'L94'] | ['T115', 'F119'] | ['G88', 'C92'] | gray | norm_green |
| ['A42', 'Q43'] | 0.002608094 | contact | 8 | ['A91', 'N92'] | ['A116', 'R117'] | ['A89', 'Q90'] | gray | norm_green |
| ['A42', 'V44'] | 0.002608094 | contact | 8 | ['A91', 'I93'] | ['A116', 'G118'] | ['A89', 'V91'] | gray | norm_green |
| ['A42', 'C45'] | 0.002608094 | contact | 8 | ['A91', 'L94'] | ['A116', 'F119'] | ['A89', 'C92'] | gray | norm_green |
| ['Q43', 'V44'] | 0.002608094 | contact | 8 | ['N92', 'I93'] | ['R117', 'G118'] | ['Q90', 'V91'] | gray | norm_green |
| ['Q43', 'C45'] | 0.002608094 | contact | 8 | ['N92', 'L94'] | ['R117', 'F119'] | ['Q90', 'C92'] | gray | norm_green |
| ['Q43', 'Q46'] | 0.002608094 | contact | 8 | ['N92', 'Q95'] | ['R117', 'Q120'] | ['Q90', 'Q93'] | gray | norm_green |
| ['Q43', 'W47'] | 0.002608094 | contact | 8 | ['N92', 'W96'] | ['R117', 'W121'] | ['Q90', 'W94'] | gray | norm_green |
| ['V44', 'C45'] | 0.002608094 | contact | 8 | ['I93','L94'] | ['G118', 'F119'] | ['V91', 'C92'] | gray | norm_green |
| ['V44', 'Q46'] | 0.002608094 | contact | 8 | ['I93', 'Q95'] | ['G118', 'Q120'] | ['V91', 'Q93'] | gray | norm_green |
| ['V44', 'W47'] | 0.002608094 | contact | 8 | ['I93', 'W96'] | ['G118', 'W121'] | ['V91', 'W94'] | gray | norm_green |
| ['V44', 'I48'] | 0.002608094 | contact | 8 | ['I93', 'I97'] | ['G118', 'F122'] | ['V91', 'I95'] | gray | norm_green |
| ['C45', 'Q46'] | 0.002608094 | contact | 8 | ['L94', 'Q95'] | ['F119', 'Q120'] | ['C92', 'Q93'] | gray | norm_green |
| ['C45', 'W47'] | 0.002608094 | contact | 8 | ['L94', 'W96'] | ['F119', 'W121'] | ['C92', 'W94'] | gray | norm_green |
| ['C45', 'I48'] | 0.002608094 | contact | 8 | ['L94', 'I97'] | ['F119', 'F122'] | ['C92', 'I95'] | gray | norm_green |
| ['C45', 'I268'] | 0.002608094 | contact | 8 | ['L94', 'I290'] | ['F119', 'I315'] | ['C92', 'I288'] | gray | norm_green |
| ['M242', 'I245'] | −0.085205182 | contact | 1 | ['M264', 'I267'] | ['M289', 'G292'] | ['S262', 'I265'] | skyblue | norm_green |
| ['F243', 'I245'] | −0.085205182 | contact | 1 | ['F265', 'I267'] | ['F290', 'G292'] | ['Y263', 'I265'] | skyblue | norm_green |
| ['F48', 'V50'] | −0.146294383 | contact | 5 | ['I97', 'F99'] | ['F122', 'V124'] | ['I95', 'F97'] | skyblue | norm_green |
| I158 | 0.014052219 | seq | 20 | L192 | L217 | I190 | gray | norm_green |
| ['P134', 'I158'] | 0.014052219 | contact | 20 | ['P168', 'L192'] | ['P193', 'L217'] | ['P166', 'I190'] | gray | norm_green |
| ['L137', 'I158'] | 0.014052219 | contact | 20 | ['L171', 'L192'] | ['L196', 'L217'] | ['L169', 'I190'] | gray | norm_green |
| ['I138', 'I158'] | 0.014052219 | contact | 20 | ['I172', 'L192'] | ['I197', 'L217'] | ['I170', 'I190'] | gray | norm_green |

TABLE 5-continued

Limited set of amino acid residues and structural contacts important for model predictions identified with L1-regularized linear regression

| feature | weights | types | groups | feature_C1C2_adjust | feature_CheRiff_adjust | feature_CsChrim_adjust | color | property |
|---|---|---|---|---|---|---|---|---|
| ['T154', 'I158'] | 0.014052219 | contact | 20 | ['T188', 'L192'] | ['T213', 'L217'] | ['T186', 'I190'] | gray | norm_green |
| ['M155', 'I158'] | 0.014052219 | contact | 20 | ['M189', 'L192'] | ['M214', 'L217'] | ['M187', 'I190'] | gray | norm_green |
| ['L157', 'I158'] | 0.014052219 | contact | 20 | ['L191', 'L192'] | ['L216', 'L217'] | ['L189', 'I190'] | gray | norm_green |
| ['I158', 'V159'] | 0.014052219 | contact | 20 | ['L192', 'V193'] | ['L217', 'V218'] | ['I190', 'V191'] | gray | norm_green |
| ['I158', 'S160'] | 0.014052219 | contact | 20 | ['L192', 'S194'] | ['L217', 'S219'] | ['I190', 'S192'] | gray | norm_green |
| ['V50', 'L52'] | −0.090367708 | contact | 18 | ['F99', 'L101'] | ['V124', 'L126'] | ['F97', 'I99'] | skyblue | norm_green |
| ['V50', 'S53'] | −0.090367708 | contact | 18 | ['F99', 'S102'] | ['V124', 'S127'] | ['F97', 'A100'] | skyblue | norm_green |
| ['V50', 'A54'] | −0.090367708 | contact | 18 | ['F99', 'A103'] | ['V124', 'A128'] | ['F97', 'I101'] | skyblue | norm_green |
| ['S53', 'L91'] | −0.090367708 | contact | 18 | ['S102', 'M130'] | ['S127', 'L155'] | ['A100', 'V128'] | skyblue | norm_green |
| ['A54', 'L91'] | −0.090367708 | contact | 18 | ['A103', 'M130'] | ['A128', 'L155'] | ['I101', 'V128'] | skyblue | norm_green |
| V50 | −0.032549576 | seq | 21 | F99 | V124 | F97 | gray | norm_green |
| W62 | −0.032549576 | seq | 21 | Y111 | W136 | F109 | gray | norm_green |
| H63 | −0.032549576 | seq | 21 | C112 | H137 | S110 | gray | norm_green |
| Y65 | −0.032549576 | seq | 21 | W114 | Y139 | W112 | gray | norm_green |
| S68 | −0.032549576 | seq | 21 | T117 | S142 | T115 | gray | norm_green |
| V69 | −0.032549576 | seq | 21 | C118 | V143 | C116 | gray | norm_green |
| S88 | −0.032549576 | seq | 21 | T127 | S152 | C125 | gray | norm_green |
| L91 | −0.032549576 | seq | 21 | M130 | L155 | V128 | gray | norm_green |
| Y99 | −0.032549576 | seq | 21 | F138 | Y163 | F136 | gray | norm_green |
| F100 | −0.032549576 | seq | 21 | H139 | F164 | K137 | gray | norm_green |
| T105 | −0.032549576 | seq | 21 | D142 | T167 | S140 | gray | norm_green |
| ['Q46', 'V50'] | −0.032549576 | contact | 21 | ['Q95', 'F99'] | ['Q120', 'V124'] | ['Q93', 'F97'] | gray | norm_green |
| ['W47', 'V50'] | −0.032549576 | contact | 21 | ['W96', 'F99'] | ['W121', 'V124'] | ['W94', 'F97'] | gray | norm_green |
| ['V50', 'L91'] | −0.032549576 | contact | 21 | ['F99', 'M130'] | ['V124', 'L155'] | ['F97', 'V128'] | gray | norm_green |
| ['V50', 'V94'] | −0.032549576 | contact | 21 | ['F99', 'F133'] | ['V124', 'V158'] | ['F97', 'V131'] | gray | norm_green |
| ['V50', 'I95'] | −0.032549576 | contact | 21 | ['F99', 'I134'] | ['V124', 'I159'] | ['F97', 'T132'] | gray | norm_green |
| ['L57', 'S88'] | −0.032549576 | contact | 21 | ['L106', 'T127'] | ['L131', 'S152'] | ['L104', 'C125'] | gray | norm_green |
| ['L57', 'L91'] | −0.032549576 | contact | 21 | ['L106', 'M130'] | ['L131', 'L155'] | ['L104', 'V128'] | gray | norm_green |
| ['V69', 'G79'] | −0.032549576 | contact | 21 | ['C118', 'G119'] | ['V143', 'G144'] | ['C116', 'G117'] | gray | norm_green |
| ['V69', 'W80'] | −0.032549576 | contact | 21 | ['C118', 'W120'] | ['V143', 'W145'] | ['C116', 'W118'] | gray | norm_green |
| ['V69', 'E82'] | −0.032549576 | contact | 21 | ['C118', 'E121'] | ['V143', 'E146'] | ['C116', 'E119'] | gray | norm_green |
| ['V69', 'R285'] | −0.032549576 | contact | 21 | ['C118', 'R307'] | ['V143', 'R332'] | ['C116', 'R305'] | gray | norm_green |
| ['V84', 'S88'] | −0.032549576 | contact | 21 | ['I123', 'T127'] | ['V148', 'S152'] | ['V121', 'C125'] | gray | norm_green |
| ['Y85', 'S88'] | −0.032549576 | contact | 21 | ['Y124', 'T127'] | ['Y149', 'S152'] | ['Y122', 'C125'] | gray | norm_green |
| ['V86', 'S88'] | −0.032549576 | contact | 21 | ['V125', 'T127'] | ['V150', 'S152'] | ['V123', 'C125'] | gray | norm_green |
| ['C87', 'S88'] | −0.032549576 | contact | 21 | ['A126', 'T127'] | ['C151', 'S152'] | ['C124', 'C125'] | gray | norm_green |
| ['C87', 'L91'] | −0.032549576 | contact | 21 | ['A126', 'M130'] | ['C151', 'L155'] | ['C124', 'V128'] | gray | norm_green |
| ['S88', 'V89'] | −0.032549576 | contact | 21 | ['T127', 'I128'] | ['S152', 'V153'] | ['C125', 'V126'] | gray | norm_green |
| ['S88', 'E90'] | −0.032549576 | contact | 21 | ['T127', 'E129'] | ['S152', 'E154'] | ['C125', 'E127'] | gray | norm_green |
| ['S88', 'L91'] | −0.032549576 | contact | 21 | ['T127', 'M130'] | ['S152', 'L155'] | ['C125', 'V128'] | gray | norm_green |
| ['S88', 'I92'] | −0.032549576 | contact | 21 | ['T127', 'I131'] | ['S152', 'I156'] | ['C125', 'L129'] | gray | norm_green |
| ['V89', 'L91'] | −0.032549576 | contact | 21 | ['I128', 'M130'] | ['V153', 'L155'] | ['V126', 'V128'] | gray | norm_green |
| ['V89', 'I92'] | −0.032549576 | contact | 21 | ['I128', 'I131'] | ['V153', 'I156'] | ['V126', 'L129'] | gray | norm_green |

TABLE 5-continued

Limited set of amino acid residues and structural contacts important for model predictions identified with L1-regularized linear regression

| feature | weights | types | groups | feature_C1C2_adjust | feature_CheRiff_adjust | feature_CsChrim_adjust | color | property |
|---|---|---|---|---|---|---|---|---|
| ['V89', 'K93'] | −0.032549576 | contact | 21 | ['I128', 'K132'] | ['V153', 'K157'] | ['V126', 'F130'] | gray | norm_green |
| ['E90', 'L91'] | −0.032549576 | contact | 21 | ['E129', 'M130'] | ['E154', 'L155'] | ['E127', 'V128'] | gray | norm_green |
| ['L91', 'I92'] | −0.032549576 | contact | 21 | ['M130', 'I131'] | ['L155', 'I156'] | ['V128', 'L129'] | gray | norm_green |
| ['L91', 'K93'] | −0.032549576 | contact | 21 | ['M130', 'K132'] | ['L155', 'K157'] | ['V128', 'F130'] | gray | norm_green |
| ['L91', 'V94'] | −0.032549576 | contact | 21 | ['M130', 'F133'] | ['L155', 'V158'] | ['V128', 'V131'] | gray | norm_green |
| ['L91', 'I95'] | −0.032549576 | contact | 21 | ['M130', 'I134'] | ['L155', 'I159'] | ['V128', 'T132'] | gray | norm_green |
| ['I92', 'V94'] | −0.032549576 | contact | 21 | ['I131', 'F133'] | ['I156', 'V158'] | ['L129', 'V131'] | gray | norm_green |
| ['I92', 'L96'] | −0.032549576 | contact | 21 | ['I131', 'I135'] | ['I156', 'L160'] | ['L129', 'L133'] | gray | norm_green |
| ['K93', 'V94'] | −0.032549576 | contact | 21 | ['K132', 'F133'] | ['K157', 'V158'] | ['F130', 'V131'] | gray | norm_green |
| ['K93', 'L96'] | −0.032549576 | contact | 21 | ['K132', 'I135'] | ['K157', 'L160'] | ['F130', 'L133'] | gray | norm_green |
| ['V94', 'I95'] | −0.032549576 | contact | 21 | ['F133', 'I134'] | ['V158', 'I159'] | ['V131', 'T132'] | gray | norm_green |
| ['I95', 'L96'] | −0.032549576 | contact | 21 | ['I134', 'I135'] | ['I159', 'L160'] | ['T132', 'L133'] | gray | norm_green |
| ['I95', 'I98'] | −0.032549576 | contact | 21 | ['I134', 'Y137'] | ['I159', 'I162'] | ['T132', 'I135'] | gray | norm_green |
| ['I95', 'Y99'] | −0.032549576 | contact | 21 | ['I134', 'F138'] | ['I159', 'Y163'] | ['T132', 'F136'] | gray | norm_green |
| ['L96', 'Y99'] | −0.032549576 | contact | 21 | ['I135', 'F138'] | ['L160', 'Y163'] | ['L133', 'F136'] | gray | norm_green |
| ['L96', 'F100'] | −0.032549576 | contact | 21 | ['I135', 'H139'] | ['L160', 'F164'] | ['L133', 'K137'] | gray | norm_green |
| ['E97', 'Y99'] | −0.032549576 | contact | 21 | ['E136', 'F138'] | ['E161', 'Y163'] | ['E134', 'F136'] | gray | norm_green |
| ['E97', 'F100'] | −0.032549576 | contact | 21 | ['E136', 'H139'] | ['E161', 'F164'] | ['E134', 'K137'] | gray | norm_green |
| ['I98', 'Y99'] | −0.032549576 | contact | 21 | ['Y137', 'F138'] | ['I162', 'Y163'] | ['I135', 'F136'] | gray | norm_green |
| ['I98', 'F100'] | −0.032549576 | contact | 21 | ['Y137', 'H139'] | ['I162', 'F164'] | ['I135', 'K137'] | gray | norm_green |
| ['Y99', 'F100'] | −0.032549576 | contact | 21 | ['F138', 'H139'] | ['Y163', 'F164'] | ['F136', 'K137'] | gray | norm_green |
| ['Y99', 'E101'] | −0.032549576 | contact | 21 | ['F138', 'E140'] | ['Y163', 'E165'] | ['F136', 'E138'] | gray | norm_green |
| ['Y99', 'T105'] | −0.032549576 | contact | 21 | ['F138', 'D142'] | ['Y163', 'T167'] | ['F136', 'S140'] | gray | norm_green |
| ['F100', 'E101'] | −0.032549576 | contact | 21 | ['H139', 'E140'] | ['F164', 'E165'] | ['K137', 'E138'] | gray | norm_green |
| ['F100', 'F102'] | −0.032549576 | contact | 21 | ['H139', 'F141'] | ['F164', 'F166'] | ['K137', 'F139'] | gray | norm_green |
| ['F100', 'T105'] | −0.032549576 | contact | 21 | ['H139', 'D142'] | ['F164', 'T167'] | ['K137', 'S140'] | gray | norm_green |
| ['F100', 'A108'] | −0.032549576 | contact | 21 | ['H139', 'A145'] | ['F164', 'A170'] | ['K137', 'A143'] | gray | norm_green |
| ['E101', 'T105'] | −0.032549576 | contact | 21 | ['E140', 'D142'] | ['E165', 'T167'] | ['E138', 'S140'] | gray | norm_green |
| ['F102', 'T105'] | −0.032549576 | contact | 21 | ['F141', 'D142'] | ['F166', 'T167'] | ['F139', 'S140'] | gray | norm_green |
| ['T105', 'P107'] | −0.032549576 | contact | 21 | ['D142', 'P144'] | ['T167', 'P169'] | ['S140', 'P142'] | gray | norm_green |
| ['T105', 'A108'] | −0.032549576 | contact | 21 | ['D142', 'A145'] | ['T167', 'A170'] | ['S140', 'A143'] | gray | norm_green |
| ['V89', 'T132'] | −0.006329808 | contact | 15 | ['I128', 'T166'] | ['V153', 'T191'] | ['V126', 'S164'] | gray | norm_green |
| ['L112', 'G114'] | −0.1067745 | contact | 7 | ['S149', 'N151'] | ['L174', 'G176'] | ['L147', 'T149'] | skyblue | norm_green |
| ['V228', 'K287'] | 0.042364014 | contact | 12 | ['V250', 'L309'] | ['L275', 'K334'] | ['V248', 'K307'] | gray | norm_green |
| ['V206', 'A208'] | 0.06519277 | contact | 13 | ['I236', 'A238'] | ['V261', 'S263'] | ['V234', 'A236'] | pink | norm_green |
| ['V206', 'H217'] | 0.06519277 | contact | 13 | ['I236', 'H240'] | ['V261', 'Y265'] | ['V234', 'H238'] | pink | norm_green |
| ['A49', 'F50'] | −0.010932852 | contact | 4 | ['T98', 'F99'] | ['A123', 'V124'] | ['A96', 'F97'] | gray | norm_green |

TABLE 5-continued

Limited set of amino acid residues and structural contacts important for model predictions identified with L1-regularized linear regression

| feature | weights | types | groups | feature_C1C2_adjust | feature_CheRiff_adjust | feature_CsChrim_adjust | color | property |
|---|---|---|---|---|---|---|---|---|
| F50 | 0.032549576 | seq | 6 | F99 | V124 | F97 | gray | norm_green |
| W65 | 0.032549576 | seq | 6 | W114 | Y139 | W112 | gray | norm_green |
| T68 | 0.032549576 | seq | 6 | T117 | S142 | T115 | gray | norm_green |
| C69 | 0.032549576 | seq | 6 | C118 | V143 | C116 | gray | norm_green |
| F99 | 0.032549576 | seq | 6 | F138 | Y163 | F136 | gray | norm_green |
| ['Q46', 'F50'] | 0.032549576 | contact | 6 | ['Q95', 'F99'] | ['Q120', 'V124'] | ['Q93', 'F97'] | gray | norm_green |
| ['W47', 'F50'] | 0.032549576 | contact | 6 | ['W96', 'F99'] | ['W121', 'V124'] | ['W94', 'F97'] | gray | norm_green |
| ['C69', 'G79'] | 0.032549576 | contact | 6 | ['C118', 'G119'] | ['V143', 'G144'] | ['C116', 'G117'] | gray | norm_green |
| ['C69', 'W80'] | 0.032549576 | contact | 6 | ['C118', 'W120'] | ['V143', 'W145'] | ['C116', 'W118'] | gray | norm_green |
| ['C69', 'E82'] | 0.032549576 | contact | 6 | ['C118', 'E121'] | ['V143', 'E146'] | ['C116', 'E119'] | gray | norm_green |
| ['C69', 'R285'] | 0.032549576 | contact | 6 | ['C118', 'R307'] | ['V143', 'R332'] | ['C116', 'R305'] | gray | norm_green |
| ['E97', 'F99'] | 0.032549576 | contact | 6 | ['E136', 'F138'] | ['E161', 'Y163'] | ['E134', 'F136'] | gray | norm_green |
| ['F99', 'E101'] | 0.032549576 | contact | 6 | ['F138', 'E140'] | ['Y163', 'E165'] | ['F136', 'E138'] | gray | norm_green |
| ['T144', 'S147'] | 0.469988727 | contact | 14 | ['T178', 'A181'] | ['T203', 'S206'] | ['S176', 'K179'] | deepolive | off_kinetics |
| C188 | 0.139320185 | seq | 5 | L218 | C243 | I216 | gray | off_kinetics |
| I189 | 0.139320185 | seq | 5 | M219 | I244 | V217 | gray | off_kinetics |
| V192 | 0.139320185 | seq | 5 | C222 | V247 | I220 | gray | off_kinetics |
| ['A174', 'V179'] | 0.139320185 | contact | 5 | ['S208', 'V212'] | ['A233', 'V237'] | ['A206', 'L210'] | gray | off_kinetics |
| ['A174', 'F186'] | 0.139320185 | contact | 5 | ['S208', 'F216'] | ['A233', 'F241'] | ['A206', 'L214'] | gray | off_kinetics |
| ['T176', 'G177'] | 0.139320185 | contact | 5 | ['K209', 'G210'] | ['T234', 'G235'] | ['T207', 'D208'] | gray | off_kinetics |
| ['T176', 'V179'] | 0.139320185 | contact | 5 | ['K209', 'V212'] | ['T234', 'V237'] | ['T207', 'L210'] | gray | off_kinetics |
| ['G177', 'W178'] | 0.139320185 | contact | 5 | ['G210', 'Y211'] | ['G235', 'W236'] | ['D208', 'W209'] | gray | off_kinetics |
| ['G177', 'K180'] | 0.139320185 | contact | 5 | ['G210', 'R213'] | ['G235', 'K238'] | ['D208', 'K211'] | gray | off_kinetics |
| ['G177', 'W184'] | 0.139320185 | contact | 5 | ['G210', 'V214'] | ['G235', 'W239'] | ['D208', 'W212'] | gray | off_kinetics |
| ['W178', 'V179'] | 0.139320185 | contact | 5 | ['Y211', 'V212'] | ['W236', 'V237'] | ['W209', 'L210'] | gray | off_kinetics |
| ['V179', 'K180'] | 0.139320185 | contact | 5 | ['V212', 'R213'] | ['V237', 'K238'] | ['L210', 'K211'] | gray | off_kinetics |
| ['V179', 'W184'] | 0.139320185 | contact | 5 | ['V212', 'V214'] | ['V237', 'W239'] | ['L210', 'W212'] | gray | off_kinetics |
| ['V179', 'L185'] | 0.139320185 | contact | 5 | ['V212', 'I215'] | ['V237', 'L240'] | ['L210', 'L213'] | gray | off_kinetics |
| ['K180', 'F186'] | 0.139320185 | contact | 5 | ['R213', 'F216'] | ['K238', 'F241'] | ['K211', 'L214'] | gray | off_kinetics |
| ['W184', 'F186'] | 0.139320185 | contact | 5 | ['V214', 'F216'] | ['W239', 'F241'] | ['W212', 'L214'] | gray | off_kinetics |
| ['W184', 'C188'] | 0.139320185 | contact | 5 | ['V214', 'L218'] | ['W239', 'C243'] | ['W212', 'I216'] | gray | off_kinetics |
| ['L185', 'F186'] | 0.139320185 | contact | 5 | ['I215', 'F216'] | ['L240', 'F241'] | ['L213', 'L214'] | gray | off_kinetics |
| ['L185', 'C188'] | 0.139320185 | contact | 5 | ['I215', 'L218'] | ['L240', 'C243'] | ['L213', 'I216'] | gray | off_kinetics |
| ['L185', 'I189'] | 0.139320185 | contact | 5 | ['I215', 'M219'] | ['L240', 'I244'] | ['L213', 'V217'] | gray | off_kinetics |
| ['F186', 'Y187'] | 0.139320185 | contact | 5 | ['F216', 'F217'] | ['F241', 'Y242'] | ['L214', 'Y215'] | gray | off_kinetics |
| ['F186', 'C188'] | 0.139320185 | contact | 5 | ['F216', 'L218'] | ['F241', 'C243'] | ['L214', 'I216'] | gray | off_kinetics |
| ['F186', 'I189'] | 0.139320185 | contact | 5 | ['F216', 'M219'] | ['F241', 'I244'] | ['L214', 'V217'] | gray | off_kinetics |
| ['Y187', 'C188'] | 0.139320185 | contact | 5 | ['F217', 'L218'] | ['Y242', 'C243'] | ['Y215', 'I216'] | gray | off_kinetics |
| ['Y187', 'I189'] | 0.139320185 | contact | 5 | ['F217', 'M219'] | ['Y242', 'I244'] | ['Y215', 'V217'] | gray | off_kinetics |
| ['Y187', 'G190'] | 0.139320185 | contact | 5 | ['F217', 'G220'] | ['Y242', 'G245'] | ['Y215', 'S218'] | gray | off_kinetics |
| ['Y187', 'L191'] | 0.139320185 | contact | 5 | ['F217', 'L221'] | ['Y242', 'L246'] | ['Y215', 'C219'] | gray | off_kinetics |

TABLE 5-continued

Limited set of amino acid residues and structural contacts important for model predictions identified with L1-regularized linear regression

| feature | weights | types | groups | feature_C1C2_adjust | feature_CheRiff_adjust | feature_CsChrim_adjust | color | property |
|---|---|---|---|---|---|---|---|---|
| ['C188', 'I189'] | 0.139320185 | contact | 5 | ['L218', 'M219'] | ['C243', 'I244'] | ['I216', 'V217'] | gray | off_kinetics |
| ['C188', 'G190'] | 0.139320185 | contact | 5 | ['L218', 'G220'] | ['C243', 'G245'] | ['I216', 'S218'] | gray | off_kinetics |
| ['C188', 'L191'] | 0.139320185 | contact | 5 | ['L218', 'L221'] | ['C243', 'L246'] | ['I216', 'C219'] | gray | off_kinetics |
| ['C188', 'V192'] | 0.139320185 | contact | 5 | ['L218', 'C222'] | ['C243', 'V247'] | ['I216', 'I220'] | gray | off_kinetics |
| ['I189', 'G190'] | 0.139320185 | contact | 5 | ['M219', 'G220'] | ['I244', 'G245'] | ['V217', 'S218'] | gray | off_kinetics |
| ['I189', 'L191'] | 0.139320185 | contact | 5 | ['M219', 'L221'] | ['I244', 'I246'] | ['V217', 'C219'] | gray | off_kinetics |
| ['I189', 'V192'] | 0.139320185 | contact | 5 | ['M219', 'C222'] | ['I244', 'V247'] | ['V217', 'I220'] | gray | off_kinetics |
| ['I189', 'Y193'] | 0.139320185 | contact | 5 | ['M219', 'Y223'] | ['I244', 'Y248'] | ['V217', 'Y221'] | gray | off_kinetics |
| ['G190', 'V192'] | 0.139320185 | contact | 5 | ['G220', 'C222'] | ['G245', 'V247'] | ['S218', 'I220'] | gray | off_kinetics |
| ['L191', 'V192'] | 0.139320185 | contact | 5 | ['L221', 'C222'] | ['L246', 'V247'] | ['C219', 'I220'] | gray | off_kinetics |
| ['V192', 'Y193'] | 0.139320185 | contact | 5 | ['C222', 'Y223'] | ['V247', 'Y248'] | ['I220', 'Y221'] | gray | off_kinetics |
| ['V192', 'G194'] | 0.139320185 | contact | 5 | ['C222', 'G224'] | ['V247', 'G249'] | ['I220', 'G222'] | gray | off_kinetics |
| ['D161', 'T197'] | −1.483821278 | contact | 13 | ['D195', 'T227'] | ['D220', 'T252'] | ['C193', 'M225'] | deepolive | off_kinetics |
| ['T164', 'T197'] | −1.483821278 | contact | 13 | ['T198', 'T227'] | ['T223', 'T252'] | ['M196', 'M225'] | deepolive | ivoff_kinetics |
| ['L191', 'G195'] | 0.142100117 | contact | 9 | ['L221', 'I225'] | ['L246', 'T250'] | ['C219', 'G223'] | orange | off_kinetics |
| ['M164', 'G190'] | 0.059247072 | contact | 6 | ['T198', 'G220'] | ['T223', 'G245'] | ['M196', 'S218'] | gray | off_kinetics |
| ['F167', 'F186'] | 0.059247072 | contact | 6 | ['W201', 'F216'] | ['M226', 'F241'] | ['F199', 'L214'] | gray | off_kinetics |
| ['F167', 'G190'] | 0.059247072 | contact | 6 | ['W201', 'G220'] | ['M226', 'G245'] | ['F199', 'S218'] | gray | off_kinetics |
| ['A170', 'F186'] | 0.059247072 | contact | 6 | ['T204', 'F216'] | ['T229', 'F241'] | ['A202', 'L214'] | gray | off_kinetics |
| ['W167', 'F187'] | −0.248666835 | contact | 12 | ['W201', 'F217'] | ['M226', 'Y242'] | ['F199', 'Y215'] | gray | off_kinetics |
| ['W167', 'M189'] | −0.248666835 | contact | 12 | ['W201', 'M219'] | ['M226', 'I244'] | ['F199', 'V217'] | gray | off_kinetics |
| ['A53', 'V91'] | −0.225257299 | contact | 2 | ['S102', 'M130'] | ['S127', 'L155'] | ['A100', 'V128'] | gray | off_kinetics |
| ['I54', 'V91'] | −0.225257299 | contact | 2 | ['A103', 'M130'] | ['A128', 'L155'] | ['I101', 'V128'] | gray | off_kinetics |
| ['L235', 'L272'] | 0.032623818 | contact | 10 | ['L257', 'M294'] | ['V282', 'L319'] | ['A255', 'I292'] | gray | off_kinetics |
| ['L235', 'I276'] | 0.032623818 | contact | 10 | ['L257', 'C298'] | ['V282', 'I323'] | ['A255', 'F296'] | gray | off_kinetics |
| ['G202', 'F237'] | 0.123927605 | contact | 8 | ['A232', 'F259'] | ['G257', 'Y284'] | ['A230', 'F257'] | gray | off_kinetics |
| ['V238', 'M242'] | 0.225164501 | contact | 7 | ['V260', 'M264'] | ['S285', 'M289'] | ['A258', 'S262'] | orange | off_kinetics |
| ['S238', 'M242'] | −0.560359462 | contact | 1 | ['V260', 'M264'] | ['S285', 'M289'] | ['A258', 'S262'] | deepolive | off_kinetics |
| ['S105', 'T109'] | −0.46738427 | contact | 4 | ['D142', 'V146'] | ['T167', 'M171'] | ['S140', 'T144'] | deepolive | off_kinetics |
| ['S105', 'S106'] | −0.387740793 | contact | 11 | ['D142', 'E143'] | ['T167', 'S168'] | ['S140', 'S141'] | gray | off_kinetics |
| ['V89', 'S132'] | −0.357155396 | contact | 3 | ['I128', 'T166'] | ['V153', 'T191'] | ['V126', 'S164'] | gray | off_kinetics |
| ['I204', 'A208'] | 0.350950625 | contact | 0 | ['V234', 'A238'] | ['I259', 'S263'] | ['C232', 'A236'] | orange | off_kinetics |
| ['L52', 'L271'] | 0.136551669 | contact | 7 | ['L101', 'L293'] | ['L126', 'L318'] | ['I99', 'I291'] | gray | peak_photocurrent |
| ['L52', 'N275'] | 0.136551669 | contact | 7 | ['L101', 'N297'] | ['L126', 'N322'] | ['I99', 'E295'] | gray | peak_photocurrent |
| ['S53', 'N275'] | 0.136551669 | contact | 7 | ['S102', 'N297'] | ['S127', 'N322'] | ['A100', 'E295'] | gray | peak_photocurrent |
| ['S105', 'T109'] | 0.487954324 | contact | 11 | ['D142', 'V146'] | ['T167', 'M171'] | ['S140', 'T144'] | palegreen | peak_photocurrent |
| ['N114'] | −0.065994456 | seq | 6 | N151 | G176 | T149 | gray | peak_photocurrent |
| ['N114', 'G115'] | −0.065994456 | contact | 6 | ['N151', 'G152'] | ['G176', 'G177'] | ['T149', 'G150'] | gray | peak_photocurrent |

TABLE 5-continued

Limited set of amino acid residues and structural contacts important for model predictions identified with L1-regularized linear regression

| feature | weights | types | groups | feature_C1C2_adjust | feature_CheRiff_adjust | feature_CsChrim_adjust | color | property |
|---|---|---|---|---|---|---|---|---|
| ['N114', 'N116'] | −0.065994456 | contact | 6 | ['N151', 'N153'] | ['G176', 'N178'] | ['T149', 'N151'] | gray | peak_photocurrent |
| ['N114', 'L173'] | −0.065994456 | contact | 6 | ['N151', 'L207'] | ['G176', 'L232'] | ['T149', 'L205'] | gray | peak_photocurrent |
| ['H139', 'G278'] | −0.021355167 | contact | 4 | ['H173', 'G300'] | ['H198', 'G325'] | ['R171', 'T298'] | gray | peak_photocurrent |
| ['H139', 'G281'] | −0.021355167 | contact | 4 | ['H173', 'G303'] | ['H198', 'G328'] | ['R171', 'A301'] | gray | peak_photocurrent |
| ['T118', 'M169'] | −0.199600713 | contact | 10 | ['T155', 'T203'] | ['T180', 'V228'] | ['A153', 'M201'] | gray | peak_photocurrent |
| ['T118', 'G172'] | −0.199600713 | contact | 10 | ['T155', 'A206'] | ['T180', 'A231'] | ['A153', 'G204'] | gray | peak_photocurrent |
| ['V206', 'A208'] | 0.326253727 | contact | 0 | ['I236', 'A238'] | ['V261', 'S263'] | ['V234', 'A236'] | palegreen | peak_photocurrent |
| ['V206', 'H217'] | 0.326253727 | contact | 0 | ['I236', 'H240'] | ['V261', 'Y265'] | ['V234', 'H238'] | palegreen | peak_photocurrent |
| ['L235', 'I272'] | −0.191853161 | contact | 2 | ['L257', 'M294'] | ['V282', 'L319'] | ['A255', 'I292'] | gray | peak_photocurrent |
| ['L235', 'F276'] | −0.191853161 | contact | 2 | ['L257', 'C298'] | ['V282', 'I323'] | ['A255', 'F296'] | gray | peak_photocurrent |
| ['L235', 'L272'] | 0.112963237 | contact | 1 | ['L257', 'M294'] | ['V282', 'L319'] | ['A255', 'I292'] | gray | peak_photocurrent |
| ['L235', 'I276'] | 0.112963237 | contact | 1 | ['L257', 'C298'] | ['V282', 'I323'] | ['A255', 'F296'] | gray | peak_photocurrent |
| ['M242', 'C269'] | −0.756058536 | contact | 9 | ['M264', 'I291'] | ['M289', 'A316'] | ['S262', 'C289'] | deepteal | peak_photocurrent |
| ['F243', 'C269'] | −0.756058536 | contact | 9 | ['F265', 'I291'] | ['F290', 'A316'] | ['Y263', 'C289'] | deepteal | peak_photocurrent |
| ['F243', 'A273'] | −0.756058536 | contact | 9 | ['F265', 'S295'] | ['F290', 'S320'] | ['Y263', 'A293'] | deepteal | peak_photocurrent |
| ['T170', 'A174'] | 0.245774599 | contact | 3 | ['T204', 'S208'] | ['T229', 'A233'] | ['A202', 'A206'] | palegreen | peak_photocurrent |
| ['A172', 'A174'] | 0.245774599 | contact | 3 | ['A206', 'S208'] | ['A231', 'A233'] | ['G204', 'A206'] | palegreen | peak_photocurrent |
| ['A172', 'K180'] | 0.245774599 | contact | 3 | ['A206', 'R213'] | ['A231', 'K238'] | ['G204', 'K211'] | palegreen | peak_photocurrent |
| ['G41', 'I264'] | −0.349941733 | contact | 12 | ['A90', 'V286'] | ['T115', 'I311'] | ['G88', 'I284'] | deepteal | peak_photocurrent |
| ['C45', 'I264'] | −0.349941733 | contact | 12 | ['L94', 'V286'] | ['F119', 'I311'] | ['C92', 'I284'] | deepteal | peak_photocurrent |
| ['A156', 'L158'] | 0.155622833 | contact | 5 | ['G190', 'L192'] | ['A215', 'L217'] | ['G188', 'I190'] | palegreen | peak_photocurrent |
| ['L158', 'D161'] | 0.425036524 | contact | 8 | ['L192', 'D195'] | ['L217', 'D220'] | ['I190', 'C193'] | palegreen | peak_photocurrent |
| ['G172' 'F247'] | −0.377312825 | contact | 13 | ['A206', 'F269'] | ['A231', 'F294'] | ['G204', 'W267'] | deepteal | peak_photocurrent |

Example 1

Functional Characterization of ChR Variants for Machine Learning

Structure-guided recombination were performed on three highly-functional ChR parents [CsChrimsonR (CsChrimR), C1C2, and CheRiff] by designing two 10-block recombination libraries with a theoretical size of ~120,000 (i.e. 2×3$^{10}$) chimeric variants with diverse functions. 102 ChR recombinant variants were selected from these recombination libraries and used as the primary dataset for model training. This dataset was supplemented with data from other published sources including 19 ChR variants from nature, 14 single-mutant ChR variants, and 28 recombination variants from other libraries (Dataset 1). Data from other sources were used to train binary classification models for ChR function.

Photocurrent strength, wavelength sensitivity and off-kinetics were used as measured properties to train machine-learning models (FIG. 1A). Enhancing ChR photocurrent strength can enable reliable neuronal activation even under low-light conditions. Different off-rates can be useful for specific applications, e.g., fast off-kinetics enable high-frequency optical stimulation, slow off-kinetics is correlated with increased light sensitivity, and very slow off-kinetics can be used for constant depolarization (step-function opsins [SFOs]). In addition to opsin functional properties, optimization or maintenance of plasma-membrane localization is also advantageous for ChR function.

Example 2

Training Gaussian Process (GP) Classification and Regression Models

Gaussian process (GP) classification and regression models were trained using the ChR sequence/structure and functional data as inputs (FIGS. 1A-F). GP models successfully predicted thermostability, substrate binding affinity, and kinetics for several soluble enzymes, and ChR membrane localization. Briefly, these models infer predictive values for new sequences from training examples by assuming that similar inputs (ChR sequence variants) will have similar outputs (photocurrent properties). To quantify the relatedness of inputs (ChR sequence variants), both sequence and structure are compared. ChR sequence information is encoded in the amino acid sequence. For structural comparisons, the 3D crystal-structural information was converted into a "contact map" that is convenient for modeling. Two residues are considered to be in contact and potentially important for structural and functional integrity if they have any non-hydrogen atoms within 4.5 Å in the C1C2 crystal structure (3UG9.pdb). The sequence and structural similarity between two variants was defined by aligning them and counting the number of positions and contacts at which they are identical.

A binary classification model was trained to predict if a ChR sequence will be functional using all 102 training sequences from the recombination library (Dataset 2) as well as data from 61 variants published by others (Dataset 1). This trained classification model was then used to predict whether uncharacterized ChR sequence variants were functional (FIG. 1B). To test prediction accuracy, 20-fold cross validation was performed on the training data set and achieved an area under the receiver operator curve (AUC) of 0.78, indicating good predictive power (Table 6). For Table 6, AUC or Pearson correlation was calculated after 20-fold cross validation on training set data for classification and regression models. The test set for both the classification and regression models was the 28 ChR sequences predicted to have useful combinations of diverse properties. Accuracy of model predictions on the test set is evaluated by AUC (for classification model) or Pearson correlation (for the regression models). The Matérn kernel is with v=5/2.

TABLE 6

Evaluation of prediction accuracy for different ChR property models.

| Model type | ChR property | Kernel | Cross validation | Test set |
|---|---|---|---|---|
| GP classification | function | Matérn | AUC = 0.78 | AUC = 1.0 |
| GP regression | current strength | Matérn | R = 0.77 | R = 0.92 |
| GP regression | off-kinetics | Matérn | R = 0.78 | R = 0.97 |
| GP regression | wavelength sensitivity | Matérn | R = 0.89 | R = 0.96 |

Next, three regression models were trained, one for each of the ChR photocurrent properties of interest: photocurrent strength, wavelength sensitivity of photocurrents, and off-kinetics (FIG. 1C). Once trained, these models were used to predict photocurrent properties of new, untested ChRs sequence variants. To test prediction accuracy, 20-fold cross validation was performed on the training dataset and observed high correlation between predicted and measured properties for all models (Pearson correlation [R] between 0.77-0.9; Tables 6 and 7). Models built using contact maps from either the ChR2 crystal structure or C1Chrimson crystal structure perform as well as models built with a contact map from the C1C2 structure (Table 8, FIGS. 5C-D) even though these maps share only 82% and 89% of their contacts with the C1C2 map, respectively (FIGS. 5A-B). For Table 3, Pearson correlation was calculated after 20-fold cross validation on training set data for regression models. The test set for the regression models was the 28 ChR sequences predicted to have useful combinations of diverse properties. Accuracy of model predictions on the test set is evaluated by Pearson correlation. All models use the Matérn kernel is with v=5/2.

TABLE 7

GP regression model hyperparameters for each ChR property of interest for the Matérn kernel.

| Model type | ChR property | Noise hyperparameter: $\sigma_n^2$ | Length hyperparameter: l |
|---|---|---|---|
| GP regression | current strength | 0.04848652 | 19.65389071 |
| GP regression | off-kinetics | 0.02902597 | 19.72715834 |
| GP regression | wavelength sensitivity | 0.10927067 | 37.7883682 |

TABLE 8

Comparison of prediction accuracy for different ChR property models with different contact maps.

| Contact map structure (pdb) | ChR property | Cross validation | Test set |
|---|---|---|---|
| C1C2 (3UG9) | current strength | R = 0.77 | R = 0.93 |
| | off-kinetics | R = 0.79 | R = 0.96 |
| | wavelength sensitivity | R = 0.90 | R = 0.96 |
| C1Chrimson (5ZIH) | current strength | R = 0.77 | R = 0.94 |
| | off-kinetics | R = 0.79 | R = 0.96 |
| | wavelength sensitivity | R = 0.91 | R = 0.96 |
| ChR2 (6EID) | current strength | R = 0.80 | R = 0.93 |
| | off-kinetics | R = 0.80 | R = 0.96 |
| | wavelength sensitivity | R = 0.91 | R = 0.96 |

Example 3

Selection of Engineered ChRs Using Trained Models

A tiered approach was used to select ChRs predicted to have a useful combination of properties (FIG. 1D). First, all ChR sequences predicted to not localize to the plasma membrane or predicted to be non-functional were eliminated. Classification models of ChR localization and function were used to predict the probability of localization and function for each ChR sequence in the 120,000-variant recombination library. Most ChR variants were predicted to not localize and not function. To focus on ChR variants predicted to localize and function, a threshold was set for the product of the predicted probabilities of localization and function (FIG. 1B); any ChR sequence above that threshold were considered for the next tier of the process. A threshold of 0.4 was selected.

The training data showed that the higher the mutation distance from one of the three parents, the less likely it was that a sequence would be functional; however, more diverse sequences could also offer more diverse functional properties. To explore diverse sequences predicted to function, 22 ChR variants that passed the 0.4 threshold were selected and were multi-block-swap sequences containing on average 70 mutations from the closest parent. These 22 sequences were synthesized, expressed in HEK cells, and their photocurrent properties were measured with patch-clamp electrophysiology. 59% of the tested sequences were functional (FIG. 1E), compared to 38% of the multi-block swap sequences randomly selected (i.e., not selected by the model) and having comparable average mutation level. This validates the classification model's ability to make useful predictions about novel functional sequences, even for sequences that are very distant from those previously tested. The models were updated by including data from these 22 sequences for future rounds of predictions.

Figure 6:
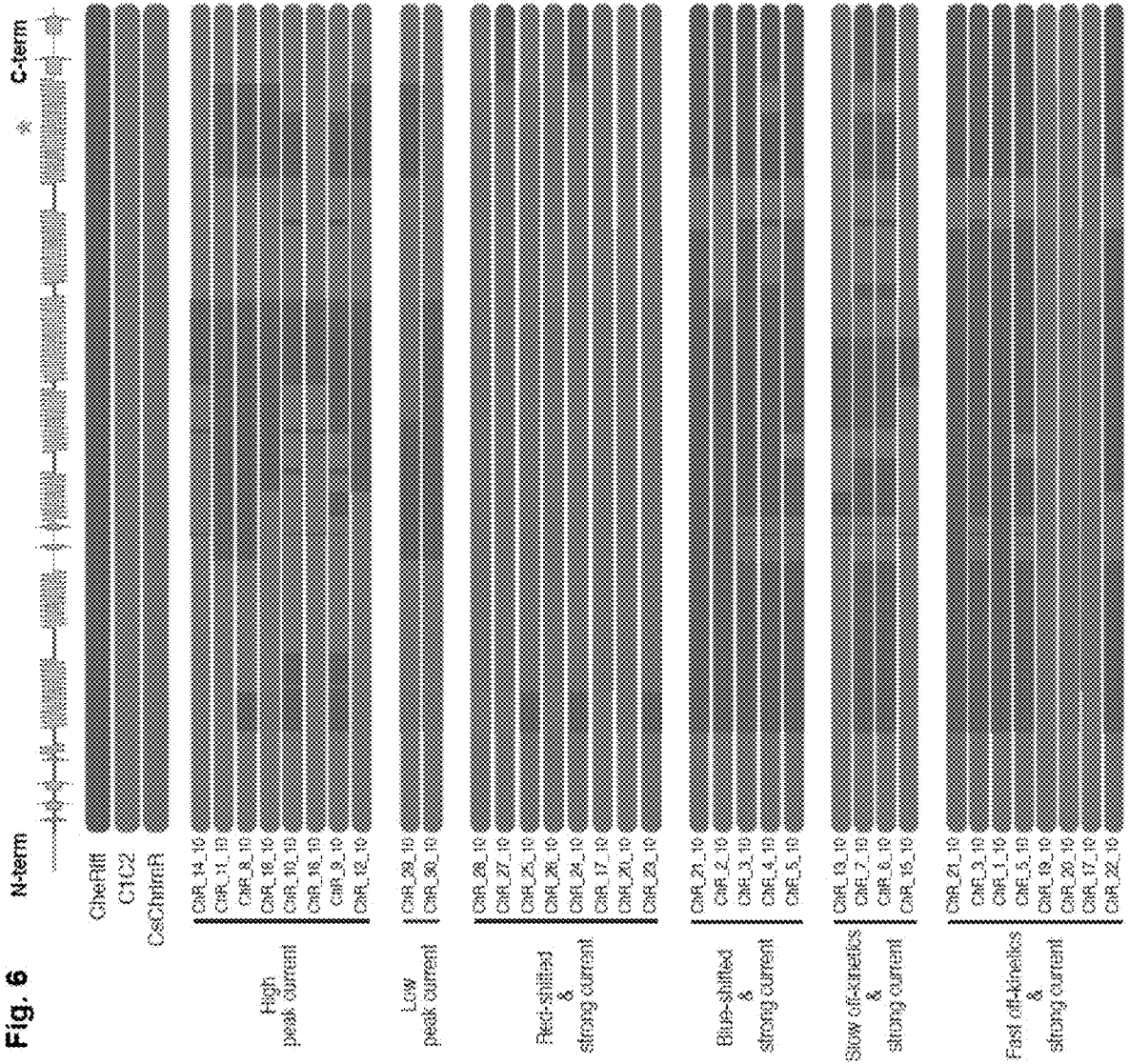
FIG. 6 shows the sequence and ChR secondary structure alignment for thirty model-predicted ChR chimeras and the three parents. Blocks of ChR chimeras are colored according to which parent each block came from. CsChrimR is red, CheRiff is blue, and C1C2 is green. (*) highlights the Schiff base. ChRs are divided into categories based on their predicted properties. The twenty-eight ChR chimeras are predicted to be optimized for one or more properties. Two ChR chimeras are predicted to produce low currents. A number of chimeras appear twice because they were optimal for multiple categories.
Figure 7:
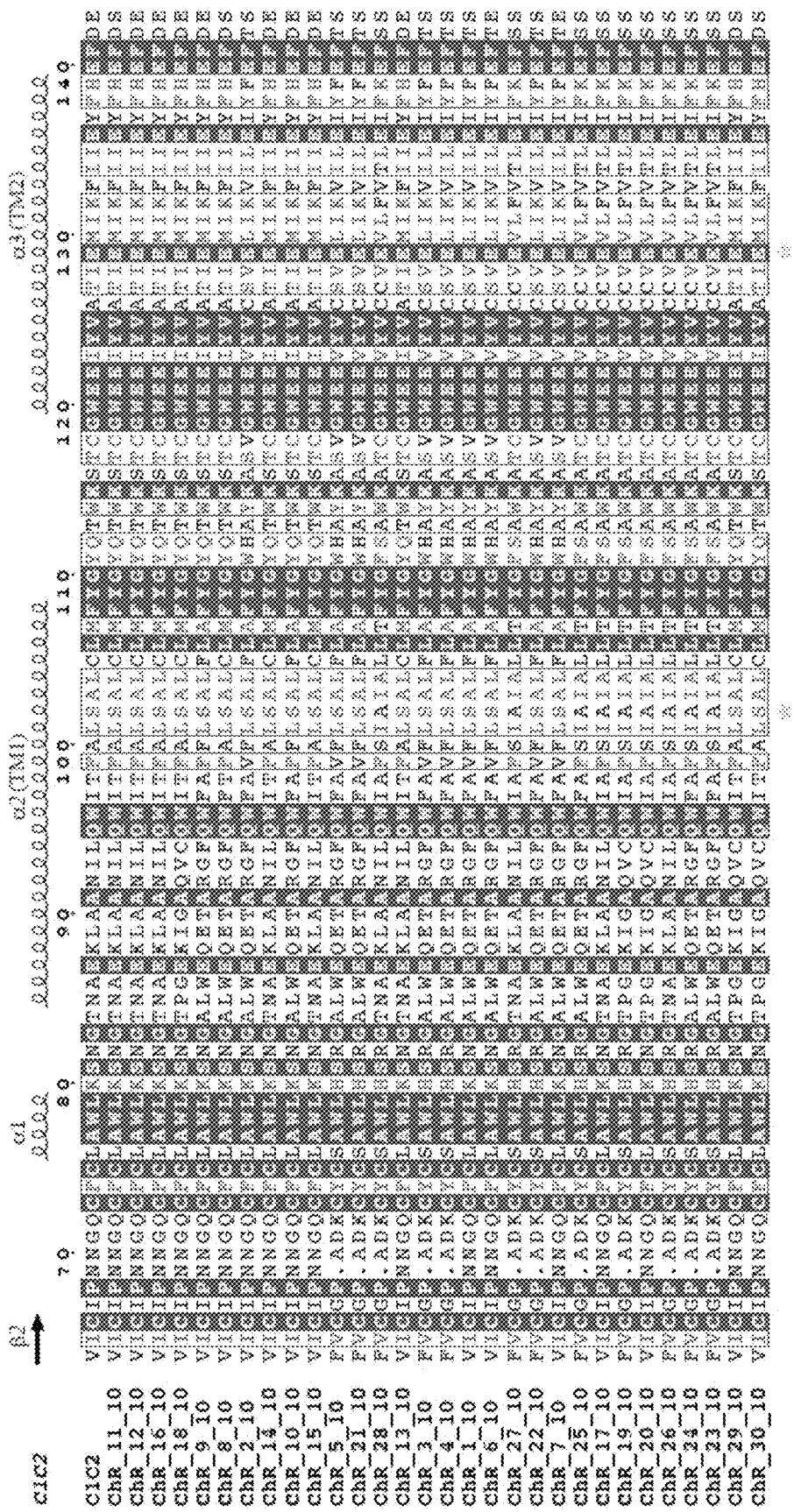
FIG. 7 shows sequence alignment between C1C2 (SEQ ID NO: 155) and the engineered ChRs (ChR_11_10: SEQ ID NO: 136; CHR_12_10: SEQ ID NO: 125; CHR_16_10: SEQ ID NO: 133; ChR_18_10: SEQ ID NO: 127; ChR_9_10: SEQ ID NO: 137; ChR_8_10: SEQ ID NO: 150; ChR_2_10: SEQ ID NO: 149; ChR_14_10: SEQ ID NO: 128; ChR_10_10: SEQ ID NO: 129; ChR_15_10: SEQ ID NO: 130; ChR_5_10: SEQ ID NO: 132; ChR_21_10: SEQ ID NO:142; ChR_28_10: SEQ ID NO: 152; ChR_13_10: SEQ ID NO: 126; ChR_3_10: SEQ ID NO: 138; ChR_4_10: SEQ ID NO: 135; ChR_1_10: SEQ ID NO: 139; ChR_6_10: SEQ ID NO: 146; ChR_27_10: SEQ ID NO: 151; ChR_22_10: SEQ ID NO: 143; ChR_7_10: SEQ ID NO: 131; ChR_25_10: SEQ ID NO: 154; ChR_17_10: SEQ ID NO: 134; ChR_19_10: SEQ ID NO: 153; ChR_20_10: SEQ ID NO: 141; ChR_26_10: SEQ ID NO: 147; ChR_24_10: SEQ ID NO: 145; ChR_23_10: SEQ ID NO: 144; ChR_29_10: SEQ ID NO: 140; and ChR_30_10: SEQ ID NO: 148). The alignment was created using ClustalΩ and visualized using ENDscript. Engineered ChRs are arranged under the C1C2 sequence in order of decreasing photocurrent strength (ChR_11_10 has the strongest photocurrents while ChR_30_10 has the weakest photocurrents). Secondary structure elements for C1C2 are shown as coils (α: α-helices) and arrows (β-strands). "TT" represents turns. Identical and conservatively substituted residues are highlighted in red (outlined in blue box). Light-blue asterisks under the alignment indicate the three residues that form the internal gate. Purple and green asterisks under the alignment indicate the residues that form the conserved hydrophobic retinal-binding pocket and the conserved cluster at the extracellular vestibule of the cation-conducting pathway, respectively. The lysine residue involved in the Schiff base is highlighted in yellow shading. The SpyTag sequence is highlighted in light blue shading.
Figure 7:
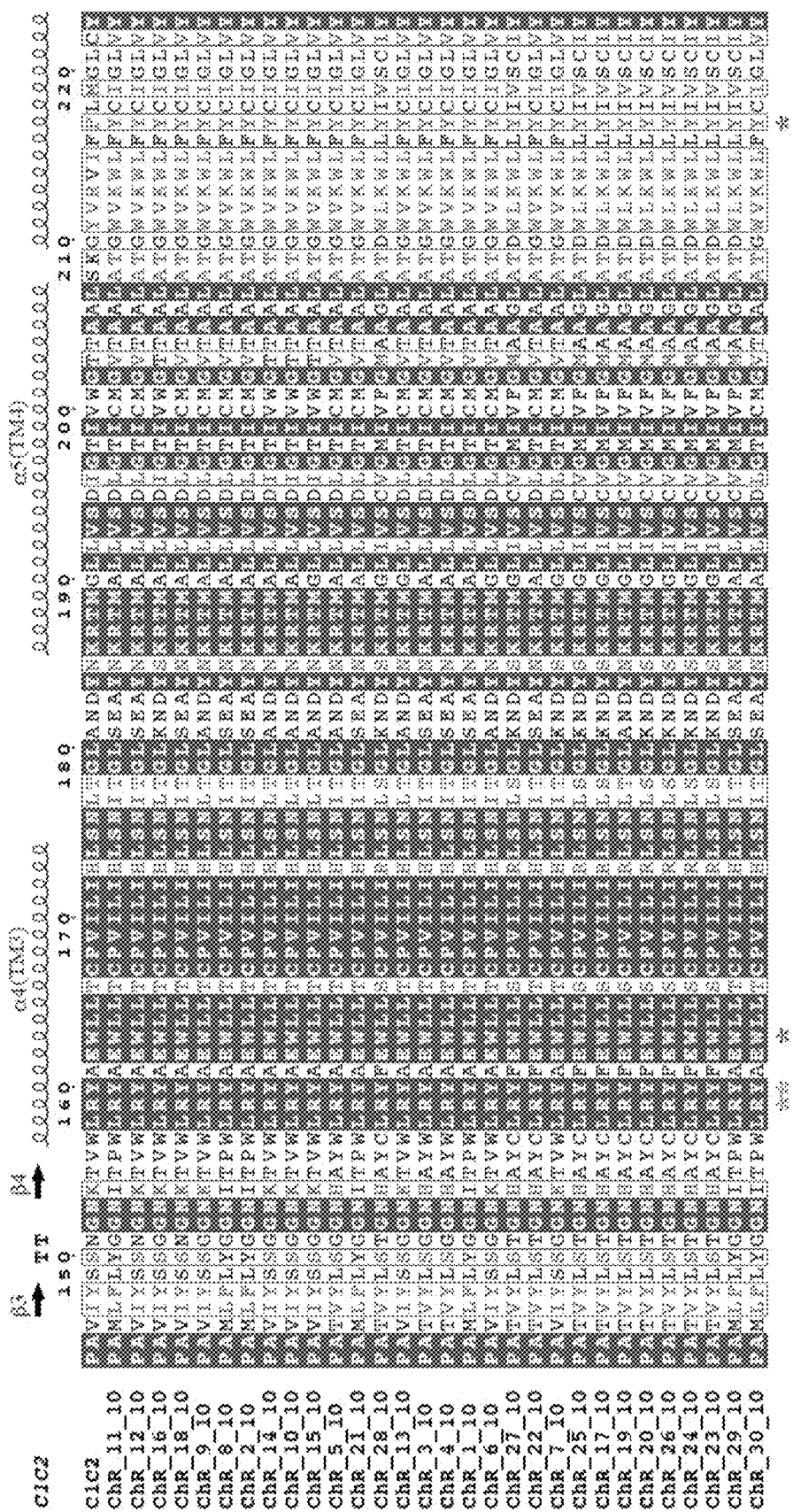
Figure 7:
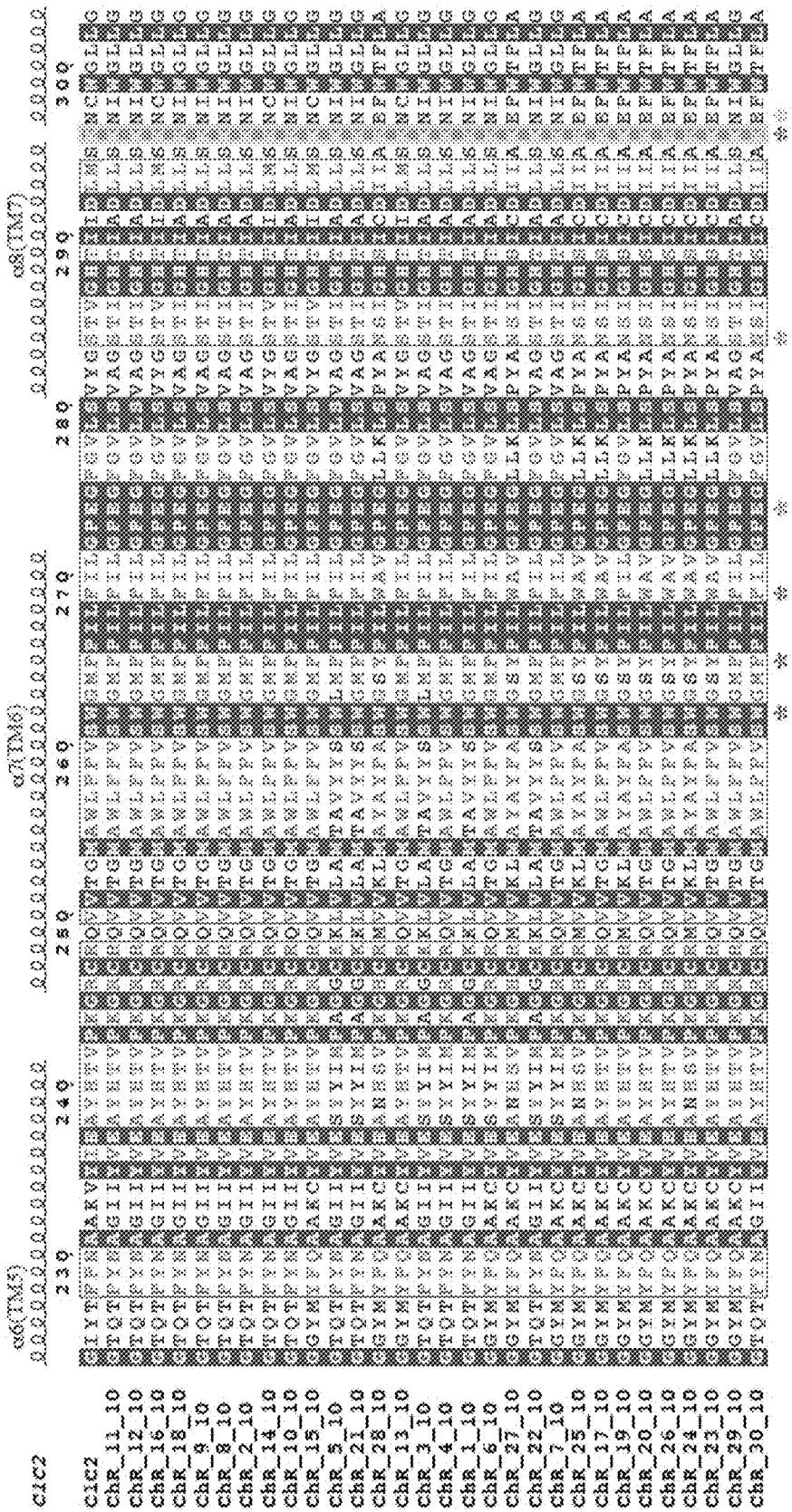
Figure 7:
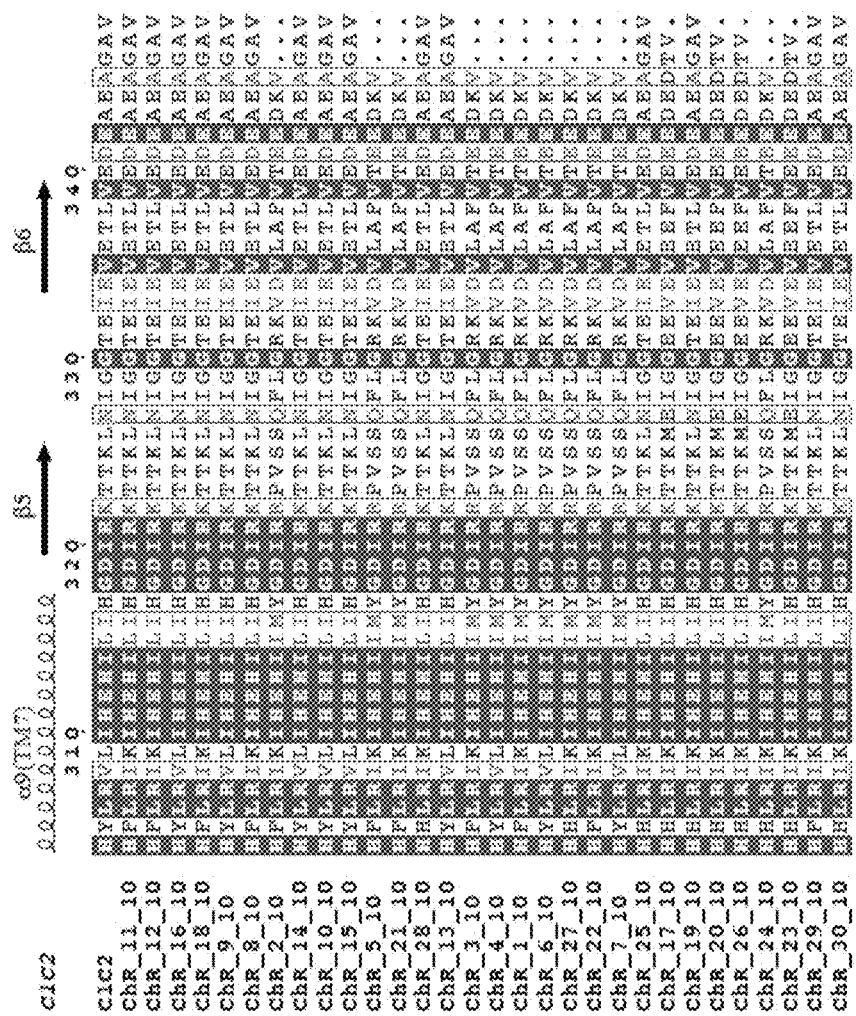

From the 120,000-variant recombination library, 1,161 chimeric sequence variants passed the conservative 0.4 predicted localization and function threshold (FIGS. 1A-F). For the second tier of the selection process, the three regression models trained on all functional variants collected up to this point were used to predict the photocurrent strength, wavelength sensitivity of photocurrents, and off-kinetics for each of these 1,161 ChR sequence variants (Dataset 3). 28 engineered ChRs predicted to be highly functional with different combinations of properties including those predicted to have the highest photocurrent strength, most red-shifted or blue-shifted activation wavelengths, and off-kinetics from very fast to very slow were selected (FIGS. 6-7).

Genes encoding the 28 selected engineered ChR variants were synthesized, expressed in HEK cells, and characterized for their photocurrent properties with patch-clamp electrophysiology. All 28 selected engineered ChRs were functional: 100% of variants selected using the updated classification model above the 0.4 threshold both localize and function. For each of the engineered ChR variants, the measured photocurrent properties correlated well with the model predictions (R>0.9 for all models) (FIG. 1F, Table 10). This outstanding performance on a novel set of sequences demonstrated the power of the data-driven predictive method described herein for engineering engineered ChRs. As a negative control, two ChR variant sequences from the recombination library that the model predicted would be non-functional (ChR_29_10 and ChR_30_10) were selected. These sequences resulted from a single-block swap from two of the most highly functional ChR recombination variants were tested and demonstrated to be non-functional (FIG. 2B), which shows that ChR functionality can be attenuated by incorporating even minimal diversity at certain positions.

Example 4

Sequence and Structural Determinants of ChR Functional Properties

Figure 8A:
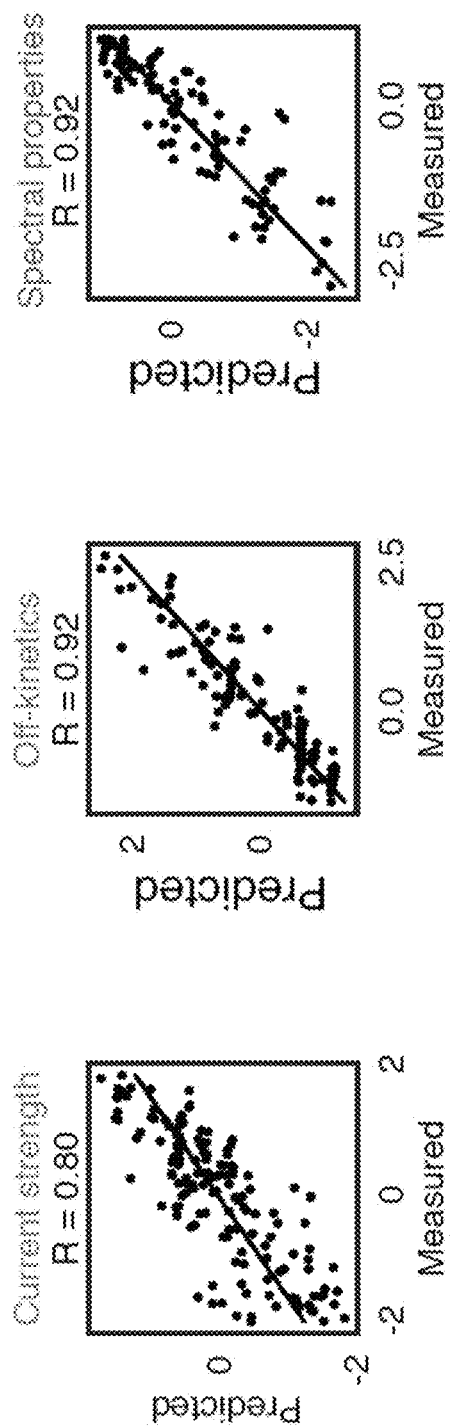
FIGS. 8A-D show sequence and structural determinants of ChR functional properties.
Figure 8B:
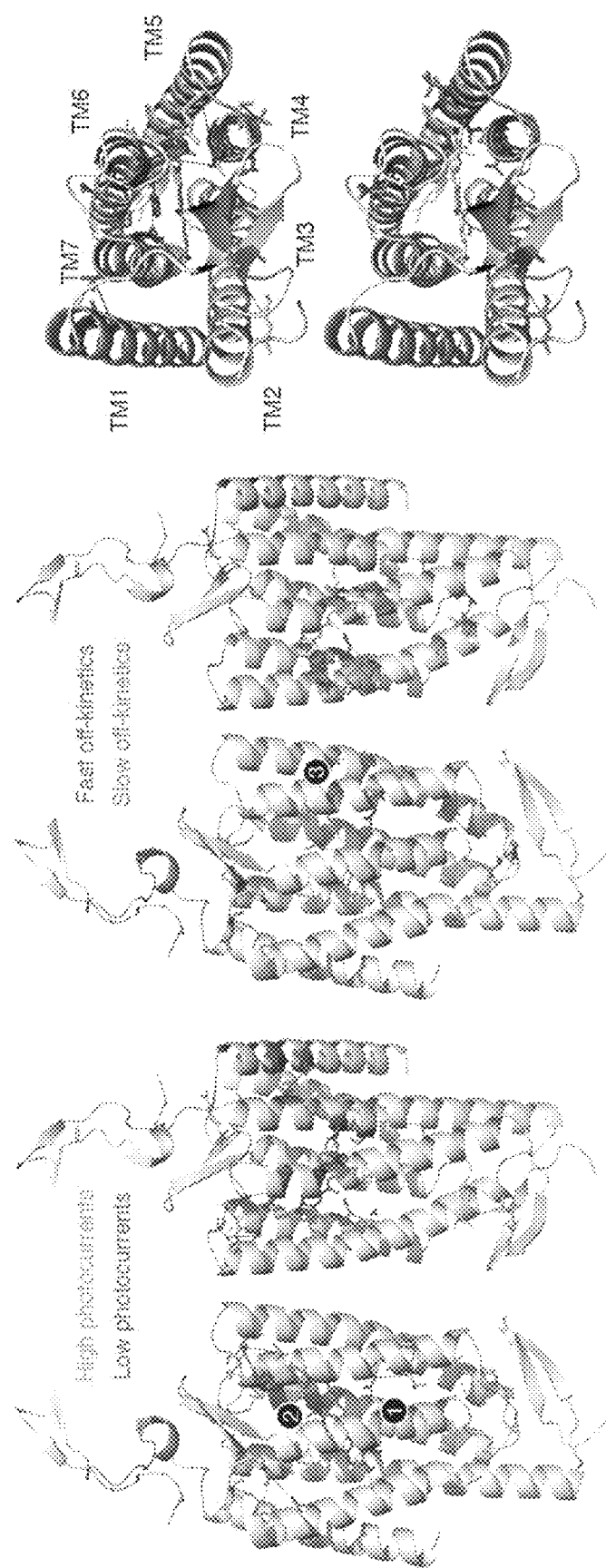
Figure 8C:
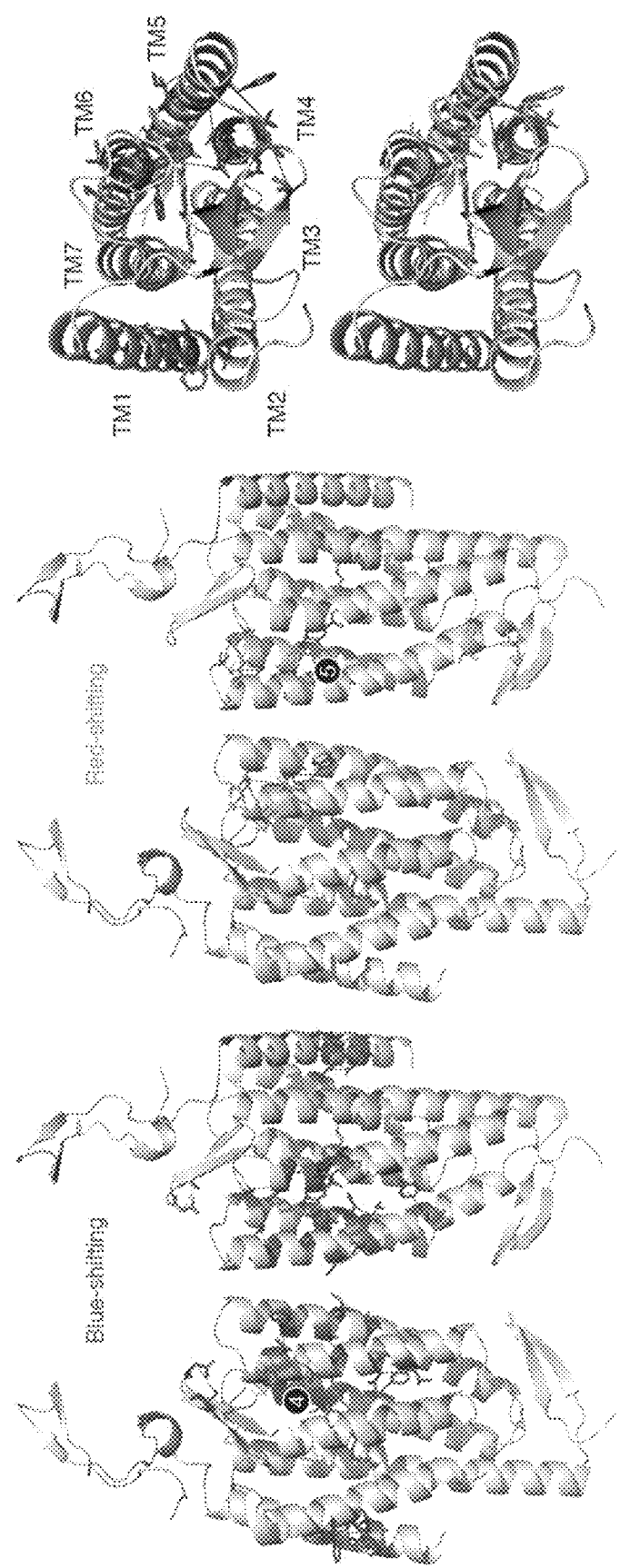
Figure 8D:
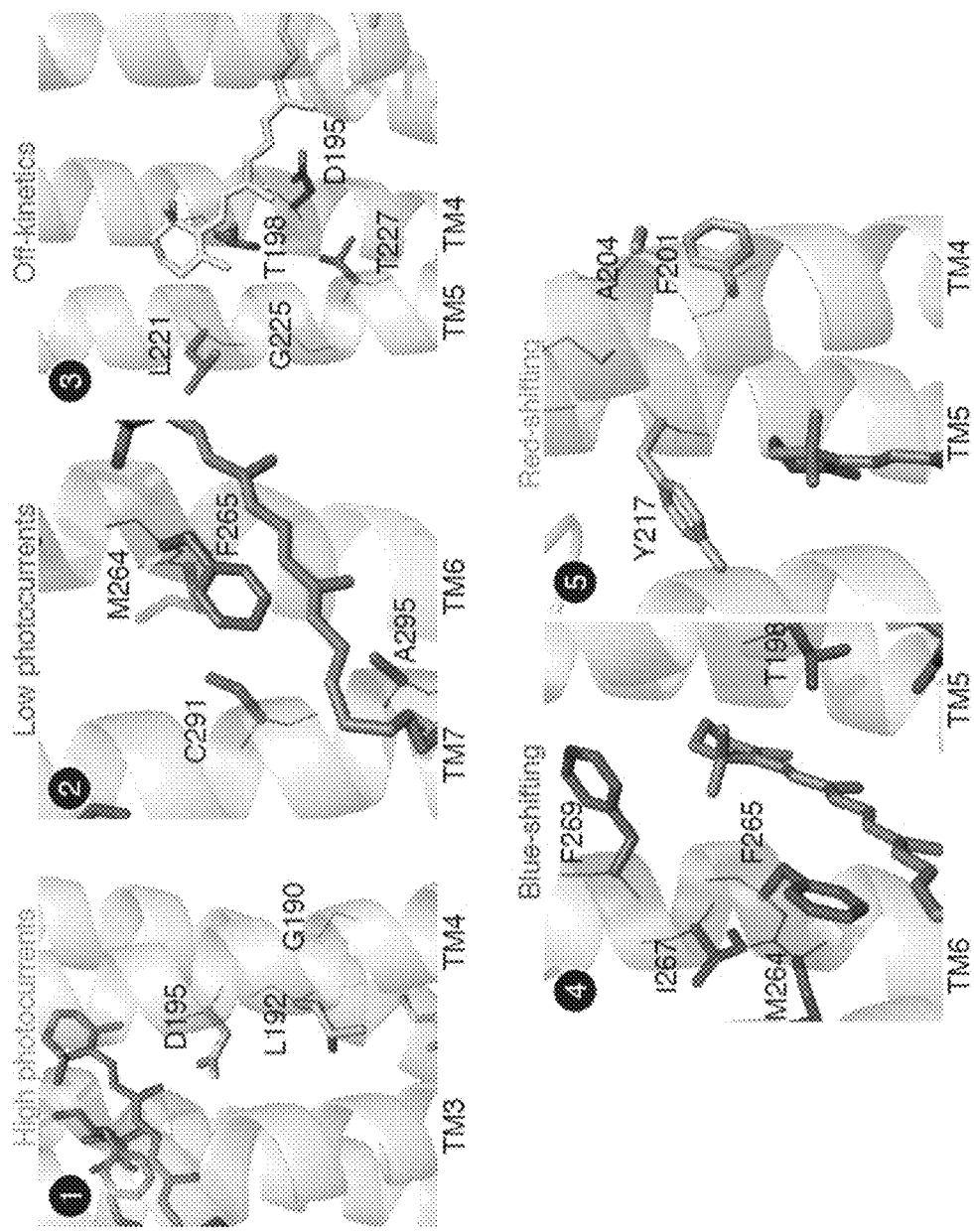

L1-regularized linear regression models were used to identify a limited set of residues and structural contacts that strongly influence ChR photocurrent strength, spectral properties, and off-kinetics (FIG. 8A). Relative importance of these sequence and structural features were assessed by weighting their contributions using L2-regularized linear regression (Dataset 4 and FIGS. 8A-D). For each functional property, a set of important residues and contacts, and their respective weights were identified. A specific residue or contact at a given position was weighted as likely to lead to, e.g., low (negative weight) or high (positive weight) photocurrents. A number of residues and contacts most important for tuning spectral properties are proximal to the retinal-binding pocket, including the blue-shifting contact between A206 and F269 and the blue-shifting contact between F265 and 1267 that are conserved in the blue-shifted parents C1C2 and CheRiff while the red-shifting contact between F201 and Y217 originates from the red-shifted CsChrimR parent (FIGS. 8A-D). The most heavily weighted contact contributing to off-kinetics includes the reside D195 (i.e., D156 according to ChR2 numbering) (FIGS. 8A-D), a residue that is part of the DC-gate. Mutation of either the aspartic acid or cysteine within the DC-gate has been shown to decrease off-kinetic speed. While the cysteine in the DC-gate is conserved in all three ChR parents, the aspartic acid at position 195 is only conserved in CheRiff and C1C2 but not in CsChrimR, which has a cysteine at that position. Interestingly, D195 is also part of a contact with L192 that contributes strongly to photocurrent strength (FIGS. 8A-D). A number of contacts proximal to retinal contribute strongly to photocurrent strength. For example, the most heavily weighted contact includes A295 (from CsChrimR), which is adjacent to the conserved lysine residue that covalently links retinal (FIGS. 8A-D). This position is a serine in both C1C2 and CheRiff.

Example 5

Figure 2A:
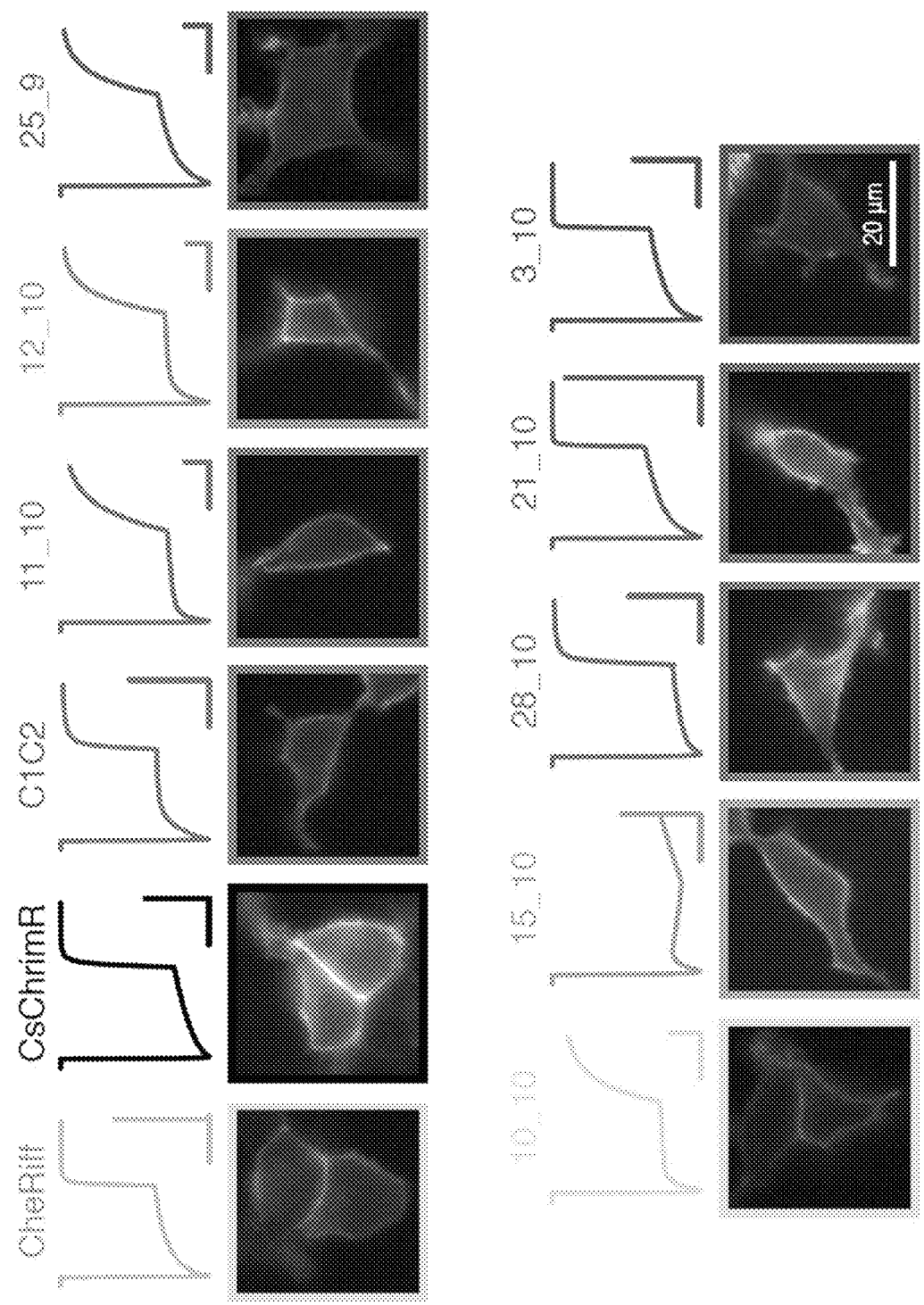

Machine-Guided Search Identifies ChRs with a Range of Useful Functional Properties Photocurrent amplitude, wavelength sensitivity, and off-kinetics of the engineered ChRs and the three parental ChRs were assessed (FIGS. 2A-E). In addition to the 28 regression model-predicted ChRs, the two top-performing ChRs from the classification models' predictions (ChR_9_4 and ChR_25_9), for a total of 30 highly-functional model-predicted ChRs as well as the two negative control ChRs (ChR_29_10, ChR_30_10) were also assessed. Of the 30 model-predicted ChRs, 12 variants were found with >2-times higher blue-light activated photocurrents than the top-performing parent (CsChrimR) (FIG. 2B). Three variants exhibit >1.7-times higher green-light activated photocurrents than CsChrimR. Eight variants have larger red-light activated photocurrents when compared with the blue-light activated parents (CheRiff and C1C2), though none out-perform CsChrimR. Both ChR variants predicted to be non-functional by the models produce <30 pA currents.

Engineered ChRs' off-kinetics span three orders of magnitude ($\tau_{off}$=10 ms→10 s) (FIG. 2C). This range is quite remarkable given that all engineered ChRs were built from sequence blocks of three parents that have similar off-kinetics ($\tau_{off}$=30-50 ms). 5 engineered ChRs were found to have faster off-kinetics than the fastest parent, while 16 have >5-times slower off-kinetics. The two fastest variants, ChR_3_10 and ChR_21_10 exhibit $\tau_{off}$=13±0.9 ms and 12±0.4 ms, respectively (mean±SEM). Four ChRs have particularly slow off-kinetics with $\tau_{off}$>1 s, including ChR_15_10, ChR_6_10, and ChR_13_10 ($\tau_{off}$=4.3±0.1 s, 8.0±0.5 s, and 17±7 s, respectively). Two ChRs with very large photocurrents, ChR_25_9 and ChR_11_10, exhibit $\tau_{off}$=220±10 ms and 330±30 ms, respectively.

Three engineered ChRs exhibit interesting spectral properties (FIG. 2E, FIGS. 9A-B). ChR_28_10's red-shifted spectrum matches that of CsChrimR, demonstrating that incorporating sequence elements from blue-shifted ChRs into CsChrimR can still generate a red-shifted activation spectrum. Two engineered ChRs exhibit novel spectral properties: ChR_11_10 has a broad activation spectrum relative to the parental spectra, with similar steady-state current strength from 400-546 nm light and strong currents (700±100 pA) when activated with 567 nm light. ChR_25_9, on the other hand, exhibits a narrow activation spectrum relative to the parental spectra, with a peak at 481 nm light.

Light sensitivity of select engineered ChRs was assessed. Compared with CsChrimR, CheRiff, and C1C2, the engineered ChRs have >9-times larger currents at the lowest intensity of light tested ($10^{-1}$ mW mm$^{-2}$), larger currents at all intensities of light tested, and minimal decrease in photocurrent magnitude over the range of intensities tested ($10^{-1}$-$10^{1}$ mW mm$^{-2}$), suggesting that photocurrents were saturated at these intensities and would only attenuate at much lower light intensities (FIG. 2D). These selected engineered ChRs are expressed at levels similar to the CsChrimR parent (the highest expressing parent) indicating that the improved photocurrent strength of these ChRs is not solely due to improved expression (FIGS. 10A-L, 11A-C).

Figure 12B:
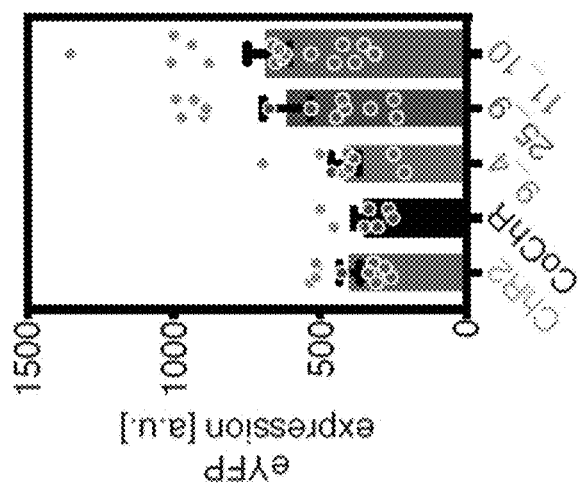
Figure 12A:
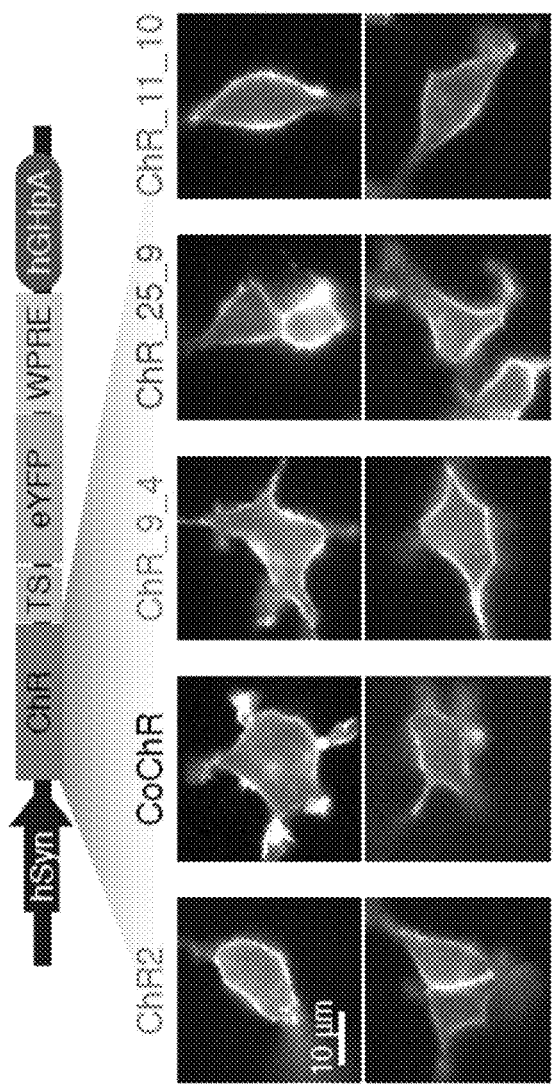
Figure 12C:
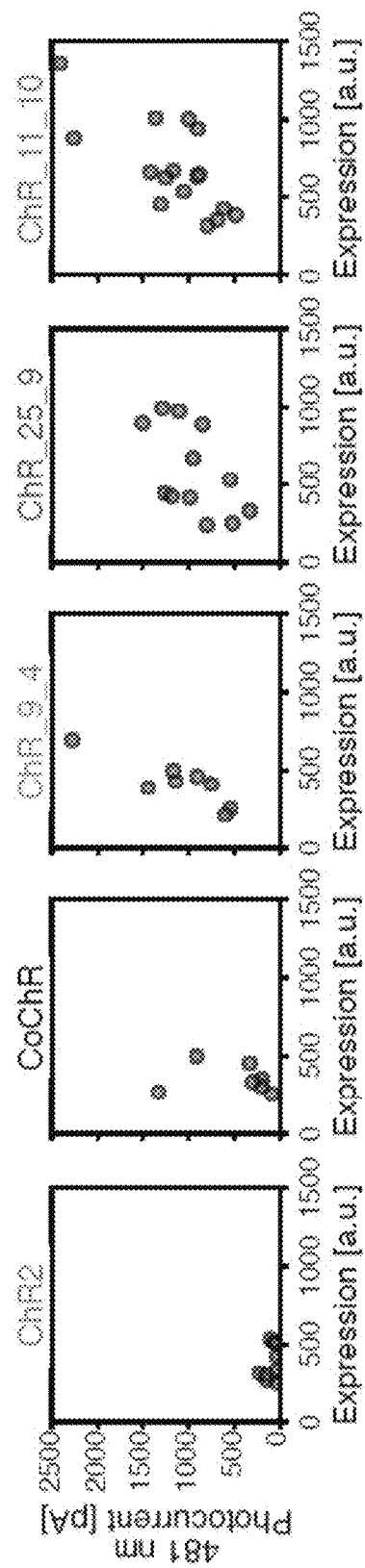

Three of the engineered ChRs, i.e., ChR_9_4, ChR_25_9, and ChR_11_10, were compared with ChR2(H134R), an enhanced photocurrent single mutant of ChR2 commonly used for in vivo optogenetics, and CoChR (from *Chloromonas oogama*), reported to be one of the highest conducting ChRs activated by blue light. The selected engineered ChRs produce 3-6× larger photocurrents than ChR2(H134R) when exposed to high-intensity (2.2 mW mm$^{-2}$) 481 nm light and 10-18× larger photocurrents than ChR2(H134R) when exposed to low-intensity (6.5×10$^{-2}$ mW mm$^{-2}$) 481 nm light (FIGS. 12F-G). Although CoChR produced peak currents of similar magnitude to the engineered ChRs, CoChR decays to a much lower steady-state level (FIGS. 12D-E) with the engineered ChRs producing 2-3× larger steady-state photocurrents than CoChR when exposed to high-intensity light and 3-4× larger steady-state photocurrents than CoChR when exposed to low-intensity light (FIGS. 12F-G; Table 9). For Table 9, ChR2(H134R), n=11 cells; CoChR, n=7 cells; ChR_9_4, n=9 cells; ChR_25_9, n=12 cells; ChR_11_10, n=16 cells. The increased low-light sensitivity of these select engineered ChRs can be due to their relatively slow off-kinetics leading to the increased accumulation of the open state under low-light conditions.

TABLE 9

Statistical analysis of peak and steady-state photocurrent presented in FIGS. 12F-G with CoChR used as a control group for Dunn's post hoc test.

| | Light intensity [mW mm$^{-2}$] | P-value peak | P-value steady-state |
|---|---|---|---|
| CoChR × ChR2(H134R) | 2.2 | 0.22 | 0.83 |
| CoChR × 9_4 | 2.2 | 0.16 | 0.030 |
| CoChR × 25_9 | 2.2 | 0.77 | 0.040 |
| CoChR × 11_10 | 2.2 | 0.25 | 0.014 |
| CoChR × ChR2(H134R) | 0.0065 | 0.37 | 0.63 |
| CoChR × 9_4 | 0.0065 | 0.12 | 0.048 |
| CoChR × 25_9 | 0.0065 | 0.10 | 0.050 |
| CoChR × 11_10 | 0.0065 | 0.016 | 0.0035 |

Example 6

Validation of Engineered ChRs for Neuroscience Applications

Figure 3A:
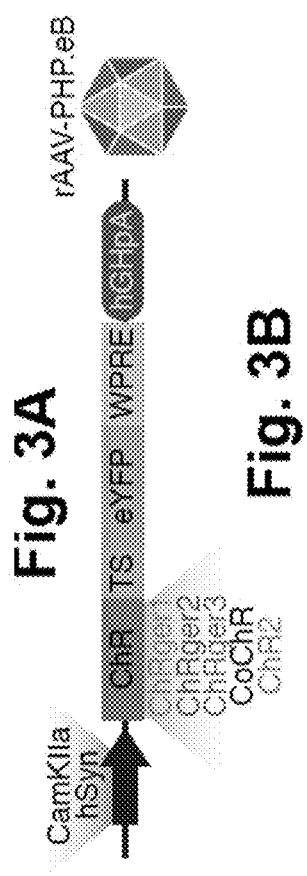
FIGS. 3A-N. ChRger variants in cultured neurons and in acute brain slices outperform the commonly used ChR2 (H134R) and the high performance CoChR.
Figure 3B:
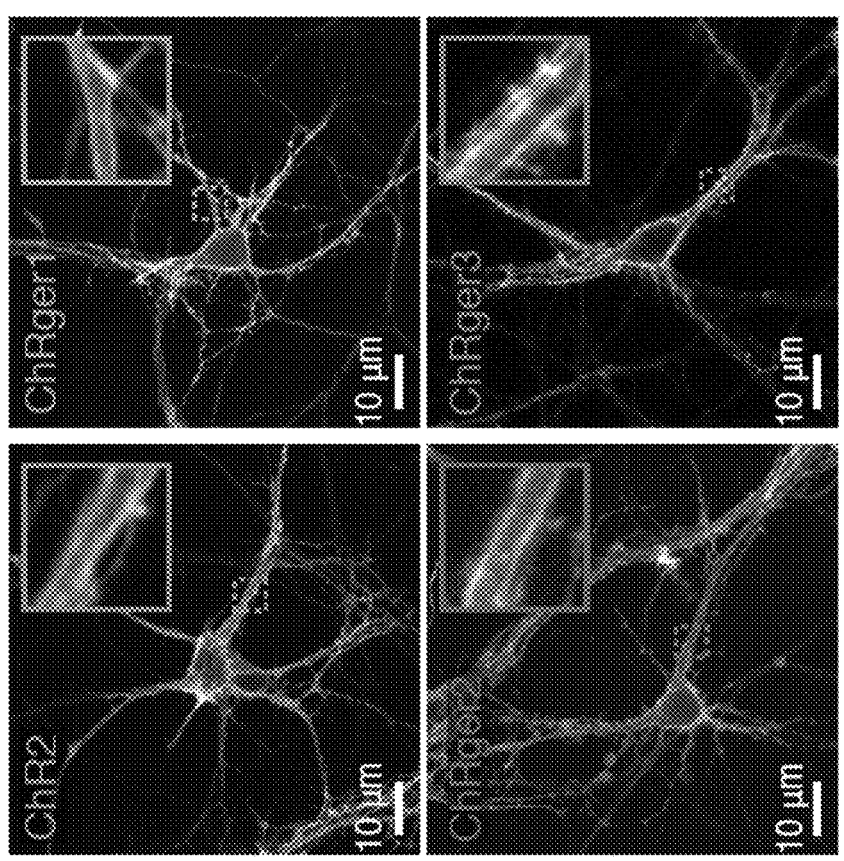
FIG. 3B shows cultured neurons expressing ChRgers and ChR2(H134R) under the hSyn promoter.
Figure 3D:
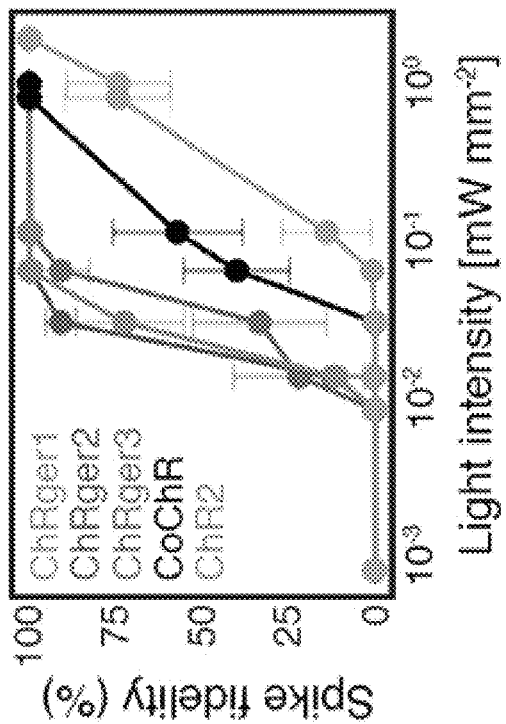
FIG. 3D shows spike fidelity with varying intensity light for 5 ms light-pulse width at 2 Hz stimulation (ChRger1, n=6 cells; ChRger2, n=6 cells; ChRger3, n=6 cells; CoChR, n=7 cells; ChR2, n=7 cells).
Figure 3E:
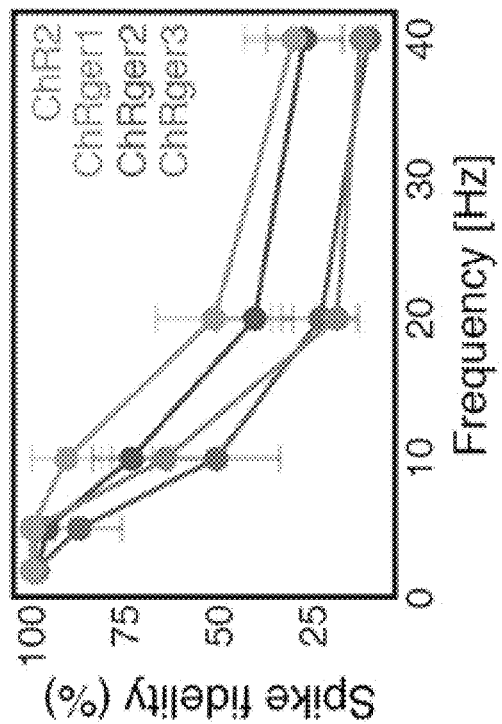
FIG. 3E shows spike fidelity with varying stimulation frequency with 2 ms light-pulse width in cultured neurons (ChRger1, n=9 cells; ChRger2, n=12 cells; ChRger3, n=7 cells; ChR2, n=8 cells).
Figure 3C:
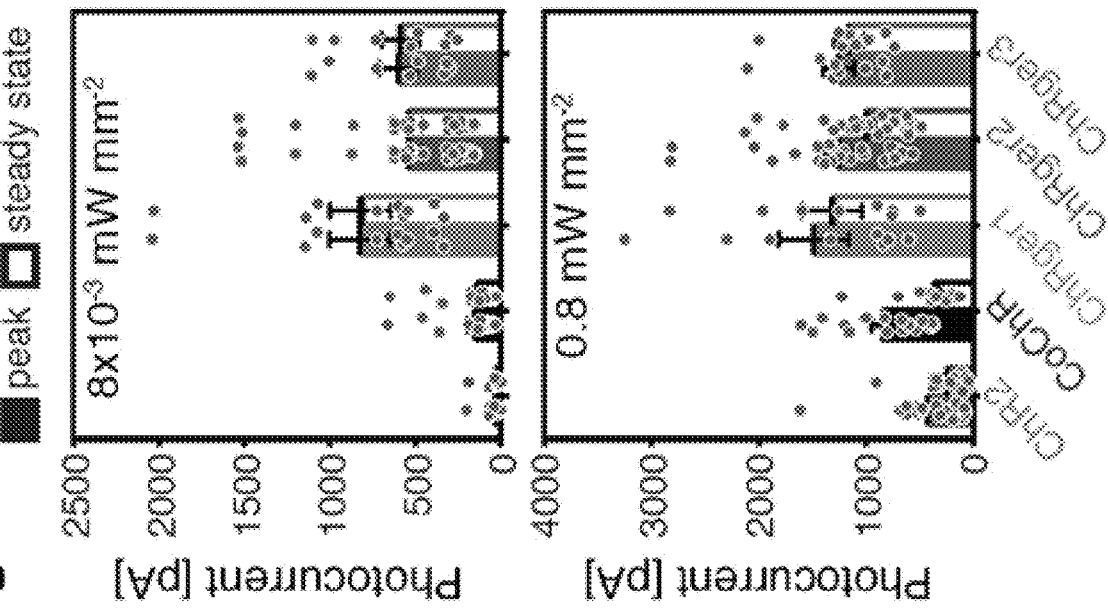
FIG. 3C shows peak and steady-state photocurrent with low-intensity (8×10$^{-3}$ mW mm$^{-2}$) and moderate-intensity (0.8 mW mm$^{-2}$) light in cultured neurons (ChR2, n=16 cells; CoChR, n=17 cells; ChRger1, n=9 cells; ChRger2, n=24 cells; ChRger3, n=9 cells).
Figure 3F:
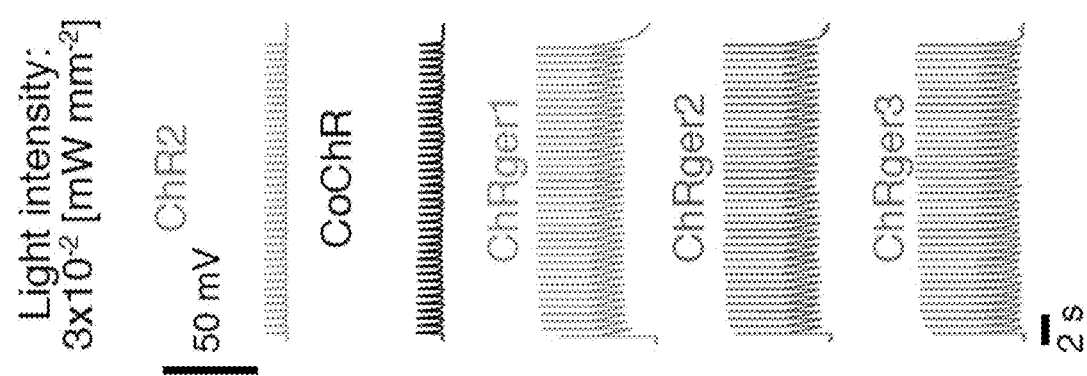
FIG. 3F illustrates that representative voltage traces of ChRgers and ChR2 (H134R) at 2 Hz with 5 ms pulsed low-intensity blue light stimulation (3×10$^{-2}$ mW mm$^{-2}$) shows robust neuronal firing for ChRgers while ChR2(H134R) and CoChR exhibit only sub-threshold light-induced depolarization.
Figure 13A:
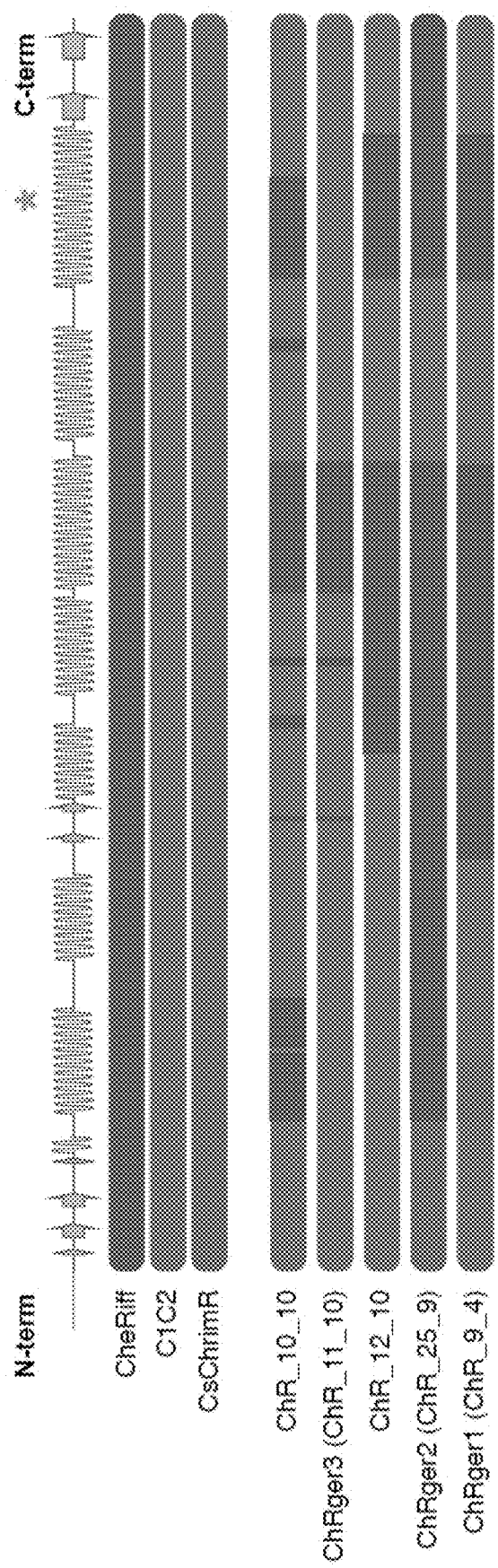
FIGS. 13A-B show alignment of five engineered ChRs.
Figure 13B:
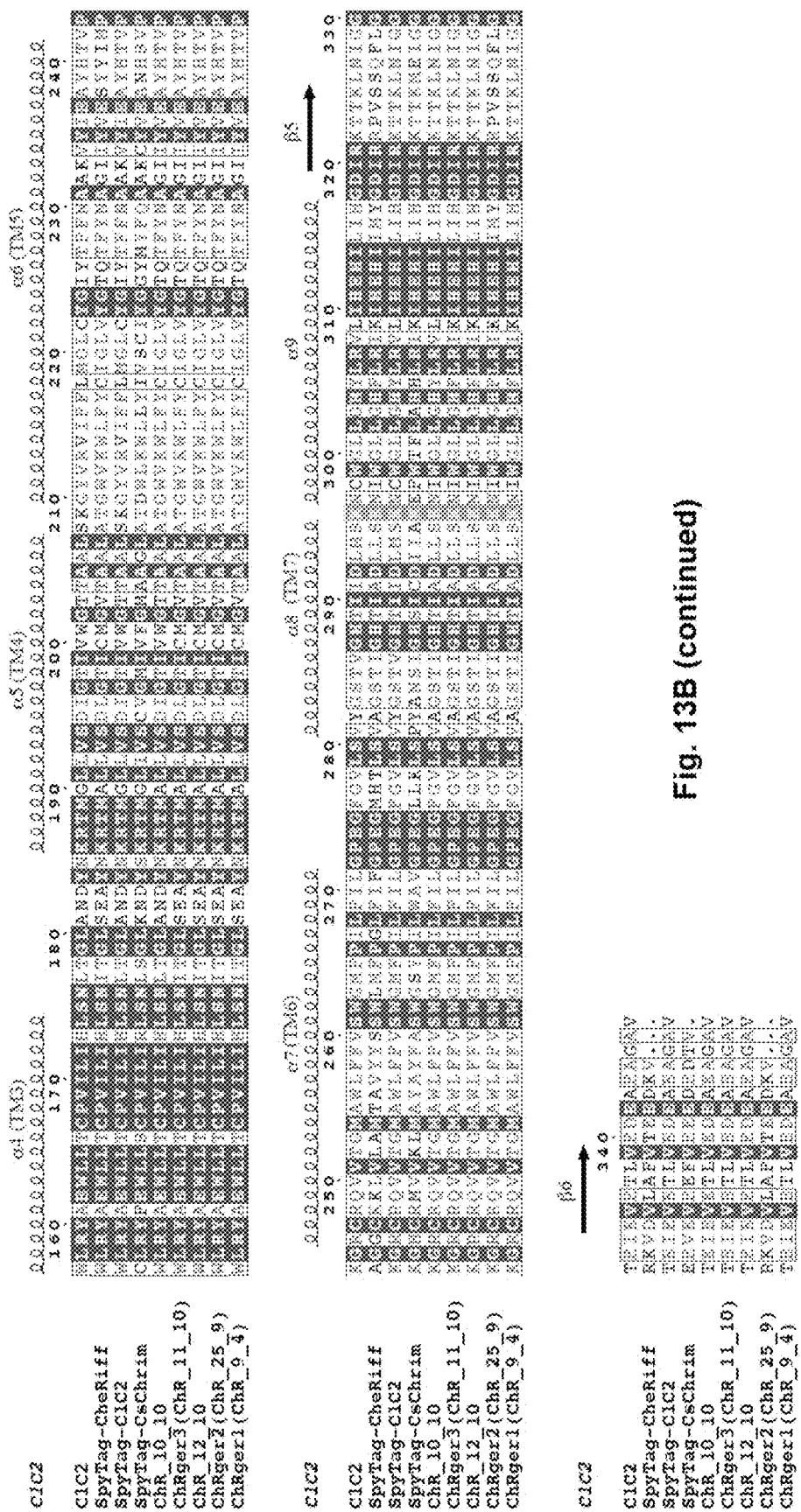

Three of the top high-conductance ChRs, ChR_9_4, ChR_25_9, and ChR_11_10, were selected for further validation, and renamed ChRger1, ChRger2, and ChRger3, respectively, for channelrhodopsin Gaussian process-engineered recombinant opsin (FIGS. 13A-B). When expressed in cultured neurons, the ChRgers display robust membrane localization and expression throughout the neuron soma and neurites (FIG. 3B). The ChRgers outperformed both CoChR and ChR2(H134R) in photocurrent strength with low-intensity light in neuronal cultures (FIG. 3C). The ChRgers require 1-2 orders of magnitude lower light intensity than CoChR and ChR2(H134R) for neuronal activation (FIG. 3D, FIG. 12H).

Next, direct intracranial injections into the mouse prefrontal cortex (PFC) of rAAV-PHP.eB packaging either ChRger1-3, or ChR2(H134R) under the hSyn promoter were performed (Table 10).

TABLE 10

List of different constructs made for validation of the ChRgers.

| Vector | Insert (X) | Virus tested |
|---|---|---|
| pAAV-hSyn-X-TS-eYFP-WPRE | hChR2(H134R) CoChR ChRger1 ChRger2 ChRger3 | Yes |
| pAAV-CaMKIIa-X-TS-eYFP-WPRE | hChR2(H134R) ChRger1 ChRger2 ChRger3 | Yes |
| pAAV-CAG-DIO[X-TS-eYFP]-WPRE | hChR2(H134R) ChRger1 ChRger2 ChRger3 | Yes |

After 3-5 weeks of expression, light sensitivity in ChR-expressing neurons was measured in acute brain slices. Greater light sensitivity for the ChRgers compared with ChR2(H134R) was observed (FIGS. 3G-H). The ChRgers exhibit >200 pA photocurrent at 10$^{-3}$ mW mm$^{-2}$ while at the equivalent irradiance ChR2(H134R) exhibits undetectable photocurrents. The ChRgers reach >1000 pA photocurrents with ~10$^{-2}$ mW mm$^{-2}$ light, a four-fold improvement over ChR2(H134R)'s irradiance-matched photocurrents (FIG. 3G).

Example 7

Engineered ChRs and Systemic AAVs Enable Minimally-Invasive Optogenetic Excitation Light-sensitive, high-photocurrent ChRs were investigated for optogenetic activation coupled with minimally-invasive gene delivery. Previous reports of "non-invasive optogenetics" relied on invasive intracranial virus delivery, which results in many copies of virus per cell and thus very high expression levels of the injected construct. AAV capsid rAAV-PHP.eB[19] that produces broad transduction throughout the central nervous system with a single minimally-invasive intravenous injection in the adult mouse were described. Systemic delivery of rAAV-PHP.eB results in brain-wide transgene delivery without invasive intracranial injections. Use of rAAV-PHP.eB for optogenetic applications has been limited, however, by the low multiplicity of infection with systemically delivered viral vectors resulting in insufficient opsin expression and light-evoked currents to control neuronal firing with commonly-used channels (e.g., ChR2).

Figure 3I:
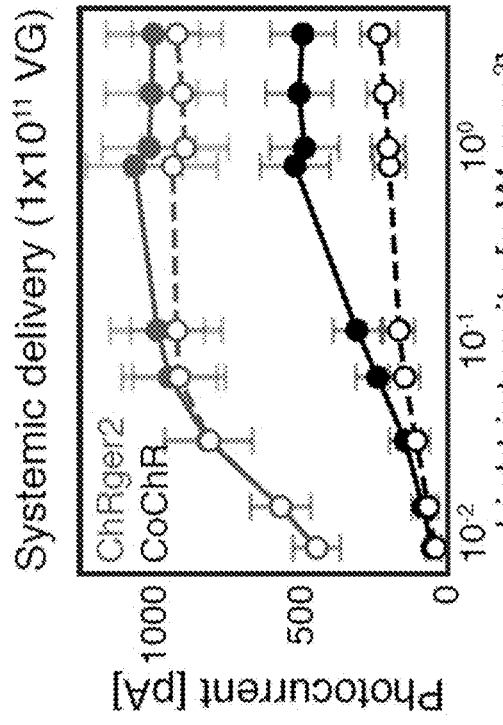
FIG. 3I shows that systemic delivery of rAAV-PHP.eB packaged hSyn-ChRger2 or hSyn-ChR2(H134R) resulted in broad expression throughout the cortex (5×10$^{11}$ vg/animal.
Figure 3K:
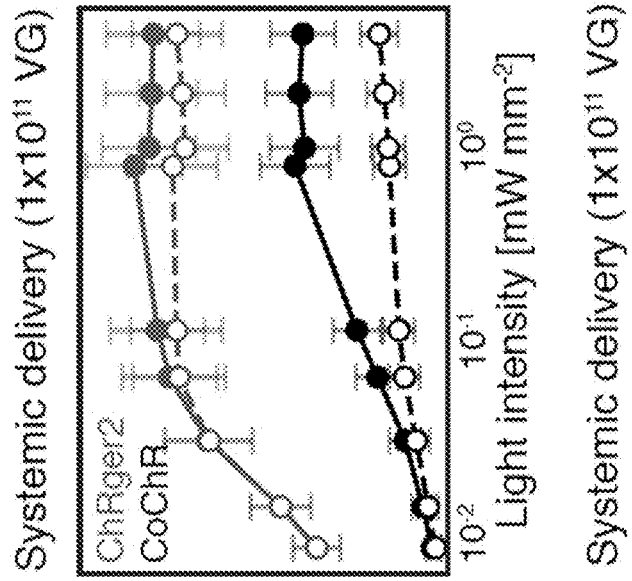
FIG. 3G shows photocurrent strength with varying light irradiances in acute brain slice after direct injection of rAAV-PHP.eB packaged hSyn-ChR constructs into the PFC (ChRger1, n=11 cells; ChRger2, n=11 cells; ChRger3, n=11 cells; ChR2, n=9 cells) or after systemic delivery of CamKIIa-ChRger2 (ChRger2, n=6 cells; 5×10$^{11}$ vg/animal).
FIG. 3H shows representative current traces of ChRgers and ChR2 (H134R) with a 300 ms light pulse at varying light irradiances in acute brain slice after direct injection.
FIG. 3J shows the fraction of light excitable neurons in the PFC after systemic delivery of hSyn-ChRs measured by cell-attached recording in acute slice targeting only neurons expressing the eYFP marker (1×10$^{11}$ vg/animal). Peak (solid line) and steady-state (dashed line) photocurrent strength (FIG. 3K) and spike fidelity (FIG. 3L) with varying light irradiances in acute brain slice after systemic delivery (1×10$^{11}$ vg/animal) of hSyn-ChRger2 (n=13 cells) and hSyn-CoChR (n=14 cells) (recorded in PFC neurons).
FIG. 3M shows spike fidelity with varying stimulation frequency in acute brain slice after systemic delivery (1×10$^{11}$ vg/animal) (CoChR, n=15 cells; ChRger1, n=9 cells; ChRger2, n=5 cells; ChRger3, n=8 cells) with 1 mW mm$^{-2}$ intensity light.
Figure 3L:
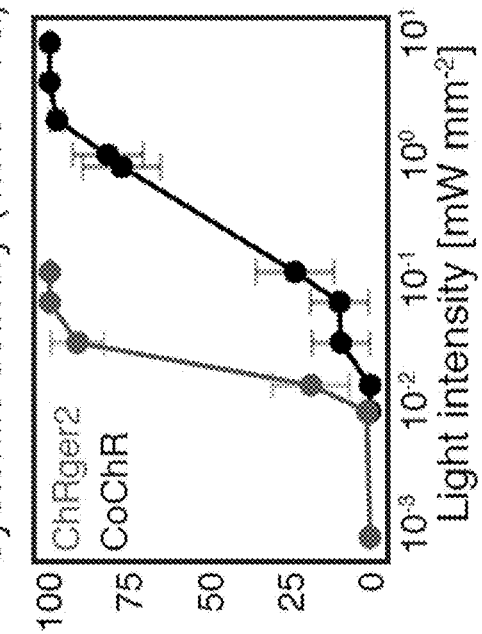
Figure 3J:
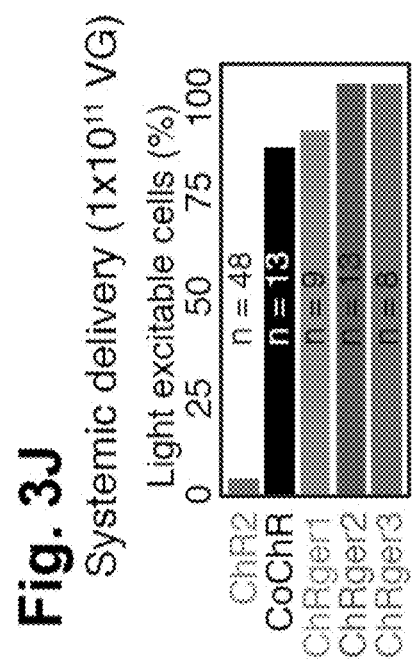
Figure 3M:
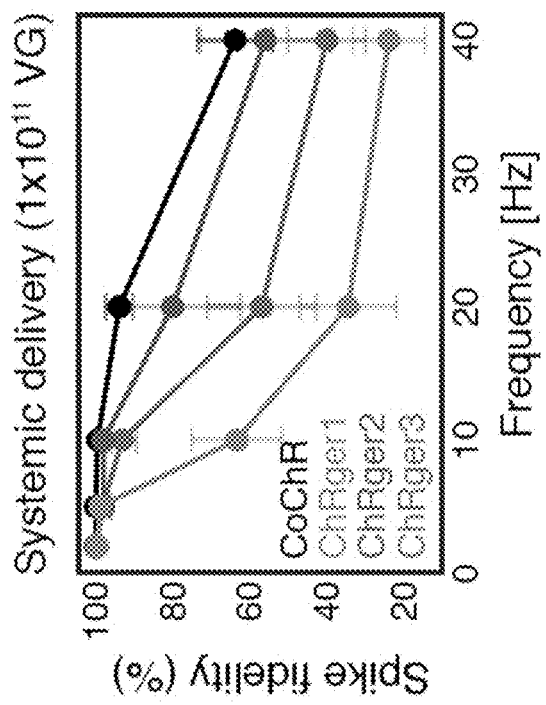
Figure 3N:
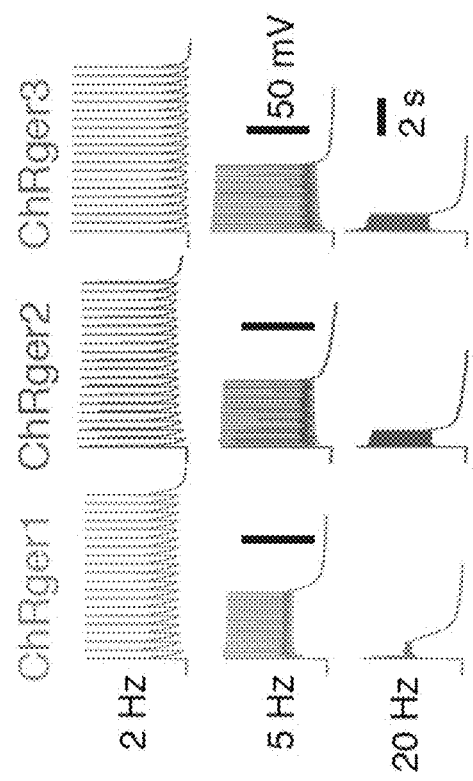

As described herein, ChRgers can allow large-volume optogenetic excitation following systemic transgene delivery. rAAV-PHP.eB packaging either ChRger1, ChRger2, CoChR, or ChR2(H134R) under the hSyn promoter was systemically delivered and observed broad expression throughout the brain (FIG. 3I). The fraction of opsin-expressing cells with sufficient opsin-mediated currents for light-induced firing was measured (FIG. 3J). Only 4% of ChR2(H134R)-expressing neurons produced light-induced firing, while 77% of CoChR-expressing neurons, 89% of ChRger1-expressing neurons, and 100% of ChRger2- or ChRger3-expressing neurons produced light-induced activity. With systemic delivery, superior light sensitivity of ChRgers was observed compared with CoChR in both photocurrent strength (FIG. 3K) and spike fidelity (FIG. 3L). ChRger2-expressing neurons exhibit healthy membrane properties similar to CoChR- or ChR2(H134R)-expressing neurons both in culture and in slice (FIGS. 14A-B).

rAAV-PHP.eB packaging ChRger1-3 under the CaMKIIa promoter were systemically delivered. With systemic delivery of ChRger2, photocurrent strength similar to results observed after direct injection into the PFC was observed (FIG. 3G). When expressed in pyramidal neurons in the cortex, ChRger2 and ChRger3 enabled robust optically-induced firing at rates between 2-10 Hz, although spike fidelity was reduced at higher frequency stimulation (FIGS. 3M-N). ChRger2 performed best with higher frequency stimulation while ChRger1 performed worst. CoChR has better spike fidelity than the ChRgers at higher frequency stimulation (20-40 Hz) (FIG. 3M).

Figure 4A:
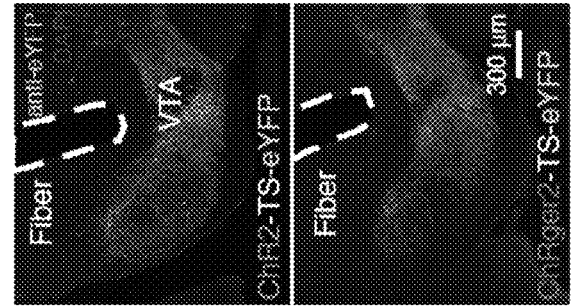
FIGS. 4A-B show validation of high-performance ChRger2 for minimally-invasive optogenetic behavioral modulation.
Figure 4A:
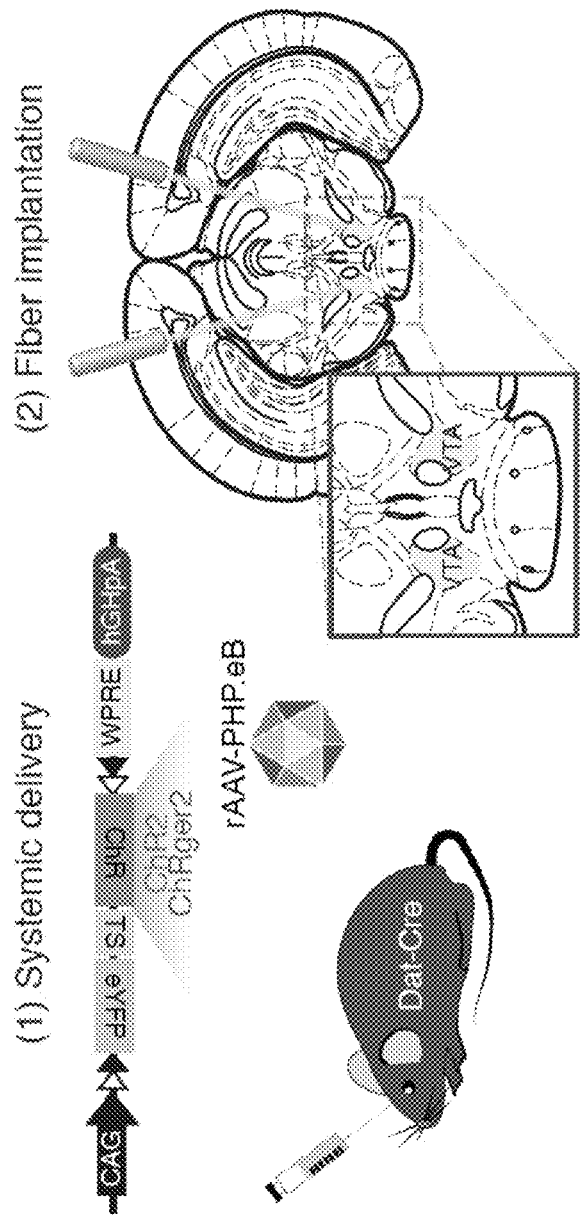
Figure 4A:
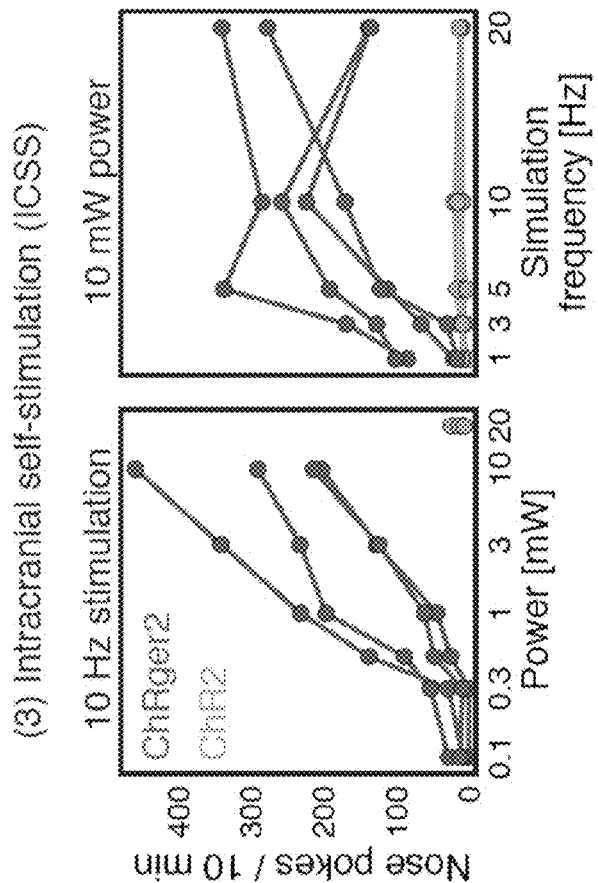

Optogenetic efficiency of ChRger2 was evaluated after systemic delivery using optogenetic intracranial self-stimulation (oICSS) of dopaminergic neurons of the ventral tegmental area (VTA)[32]. rAAV-PHP.eB packaging a double-floxed inverted open reading frame (DIO) containing either ChRger2 or ChR2(H134R) were systemically delivered into Dat-Cre mice (FIG. 4A, Table 10). Three weeks after systemic delivery and stereotaxic implantation of fiber-optic cannulas above the VTA, mice were placed in an operant box and were conditioned to trigger a burst of 447 nm laser stimulation via nose poke. Animals expressing ChRger2 displayed robust optogenetic self-stimulation in a frequency-dependent and laser power-dependent manner. Higher frequencies (up to 20 Hz) and higher light power (up to 10 mW) promoted greater maximum operant response rates (FIG. 4A). Conversely, laser stimulation failed to reinforce operant responding in ChR2(H134R)-expressing animals (FIG. 4A); these results were consistent with results in acute slice where the light-induced currents of ChR2 (H134R) were too weak at the low copy number produced by systemic delivery for robust neuronal activation.

Figure 4B:
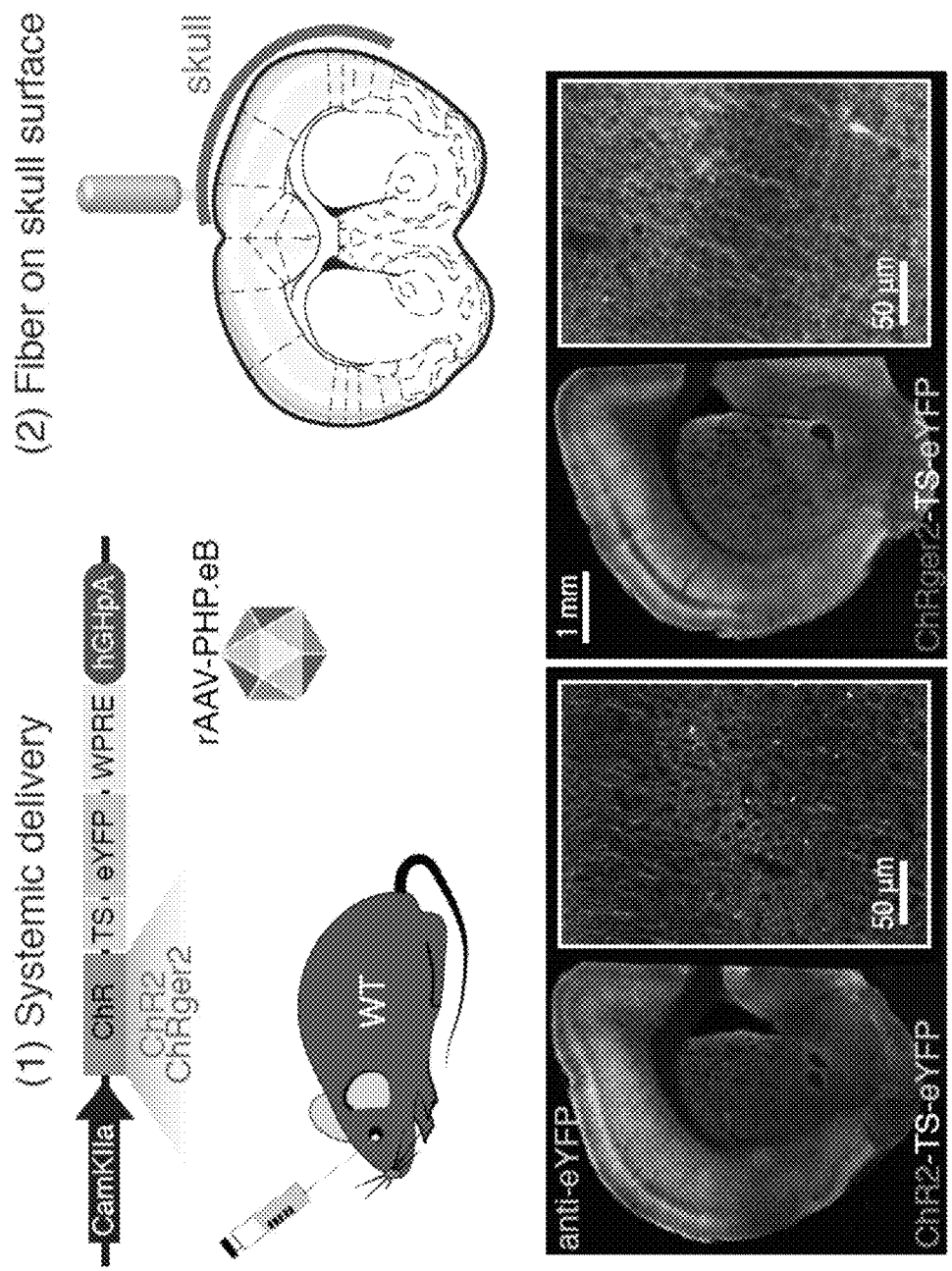
Figure 4B:
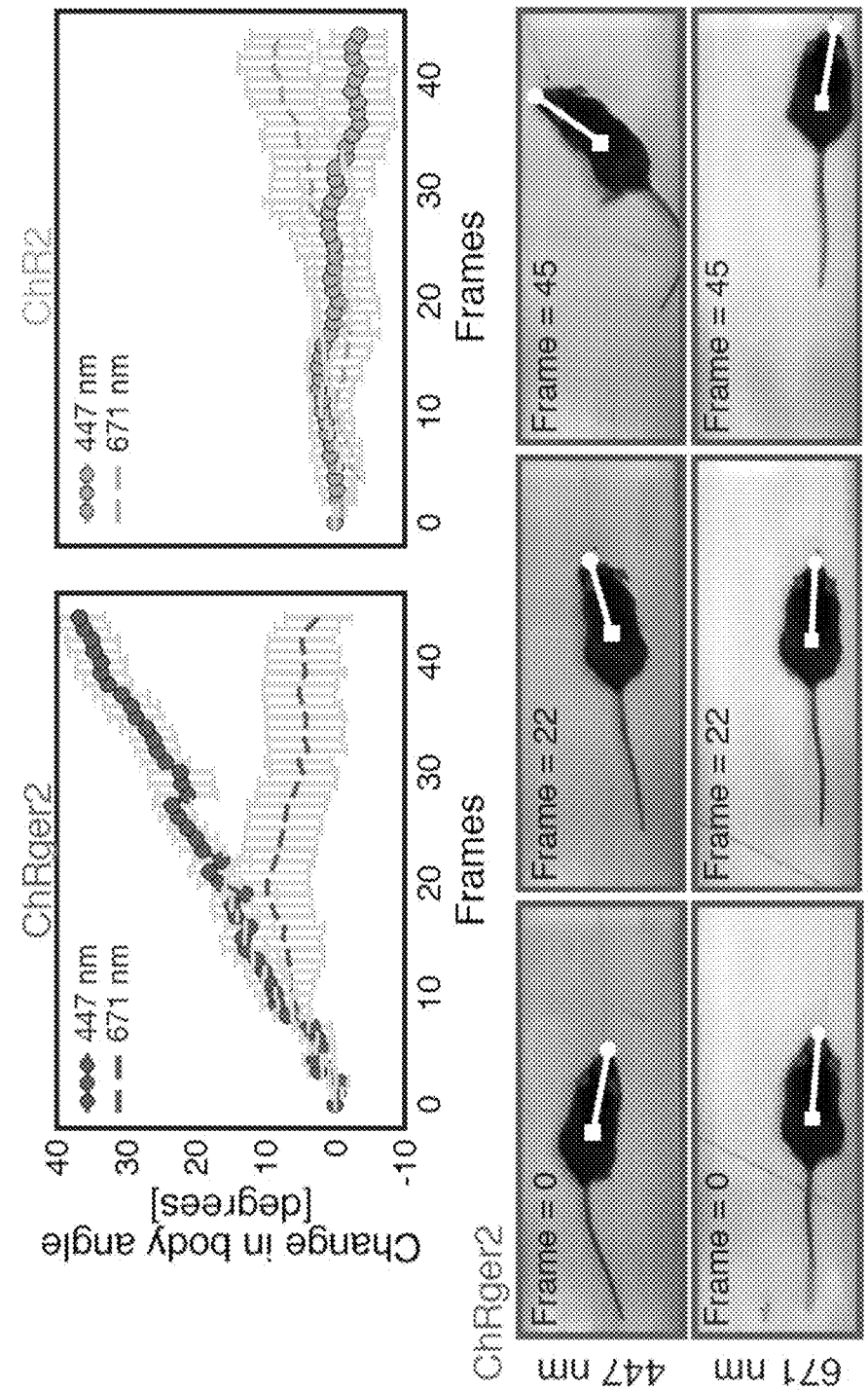
Figure 15:
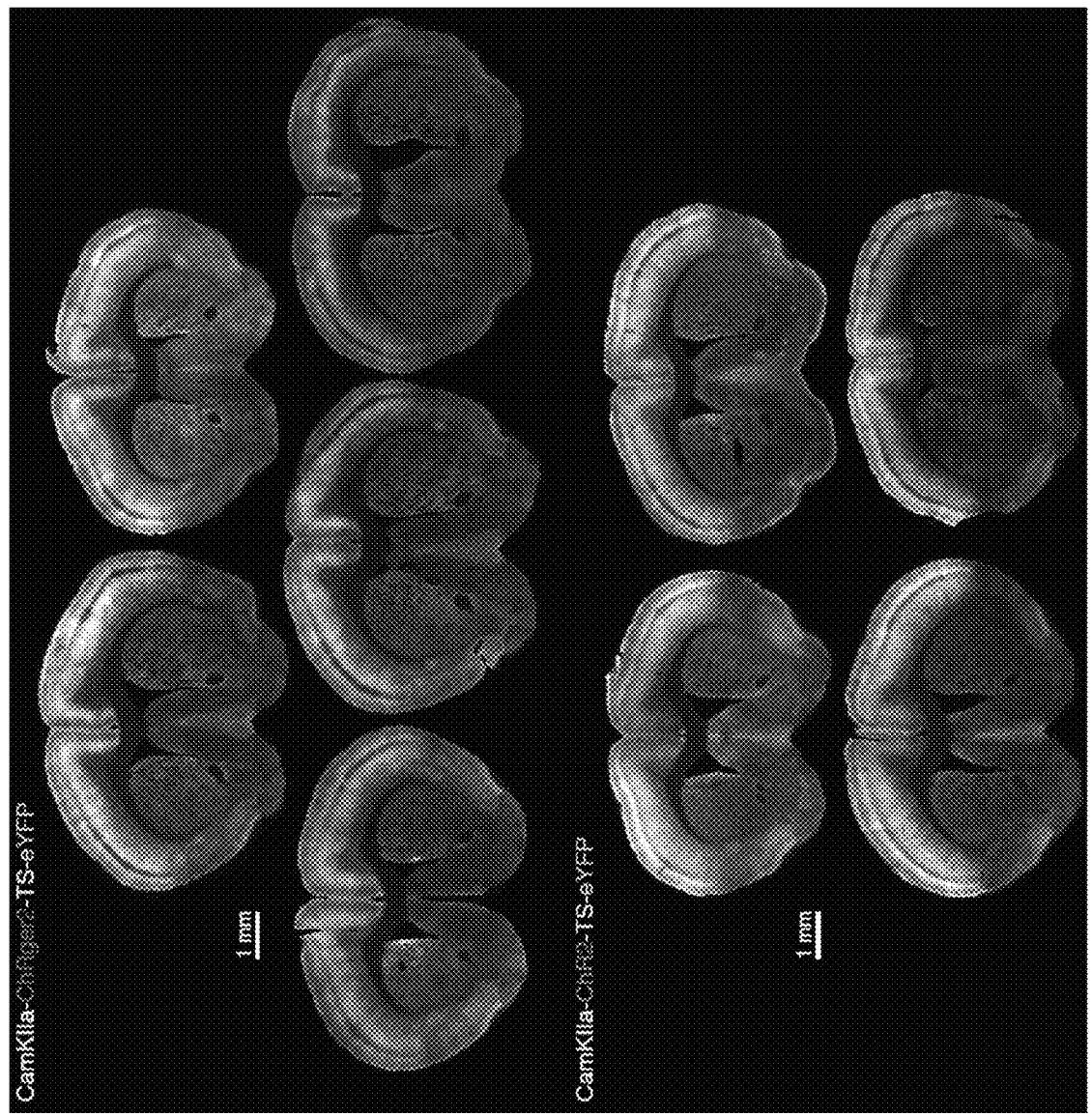
FIG. 15: coronal slices show expression throughout cortex after systemic delivery of ChRger2 and ChR2(H134R). Systemic delivery of rAAV-PHP.eB packaged CaMKIIa ChRger2-TS-eYFP or ChR2(H134R)-TS-eYFP into wild type animals. ChRger2, n=5 animals; ChR2(H134R), n=4 animals. These animals were used for behavioral experiments depicted in FIG. 4B. Observable tissue damage occurred during tissue collection and processing. Virus titer, 5×10$^{11}$ vg/mouse.

In order to determine if ChRger2 would enable both minimally-invasive transgene delivery and minimally-invasive optical excitation, directional control of locomotion was assayed in freely moving animals by optogenetic stimulation of the right secondary motor cortex (M2). In this assay, unilateral stimulation of M2 disrupts motor function in the contralateral lower extremities, causing mice to turn away from the stimulation side. rAAV-PHP.eB packaging either ChRger2 or ChR2(H134R) under a CaMKIIa promoter were systemically administered for transgene expression in excitatory pyramidal neurons in the cortex (FIG. 4B, Table 10). Broad expression was observed throughout the cortex for both ChRger2 and ChR2(H134R) injected animals (FIG. 15). A fiber-optic cannula guide was secured to the surface of the thinned skull above M2 without puncturing the dura and therefore leaving the brain intact (FIG. 4B), which is considered to be minimally invasive. Despite the presence of the highly optically scattering calavarial bone, stimulation with 20 mW 447 nm light induced left-turning behavior in animals expressing ChRger2 but not in animals expressing ChR2(H134R) (FIG. 4B). It was observed that left-turning behavior terminated upon conclusion of optical stimulation. Behavioral effects were seen at powers as low as 10 mW. To ensure that the turning behavior was not due to visual stimuli or heating caused by the stimulation laser, treadmill experiments were repeated using 671 nm light, which is outside the excitation spectrum of both opsins. 20 mW 671 nm light failed to induce turning in both ChRger2 and ChR2(H124R). Overall, these experiments demonstrated that ChRger2 is compatible with minimally-invasive systemic gene delivery and can enable minimally-invasive optogenetic excitation. Coupling ChRgers with recently reported upconversion nanoparticles may allow for non-invasive optogenetics in deep brain areas with systemic transgene delivery and tissue-penetrating near-infrared (NIR) light for neuronal excitation.

As described herein, a data-driven approach was utilized herein to engineering ChR properties that enables efficient discovery of highly functional ChR variants based on data from relatively few variants. In this approach, a set of ~120,000 chimeric ChRs was approximate and used to efficiently search sequence space and select top-performing variants for a given property. By first eliminating the vast majority of non-functional sequences, local peaks scattered throughout the landscape were focused. Then, using regression models, sequences lying on the fitness peaks were predicted.

Machine learning provides a platform for simultaneous optimization of multiple ChR properties that follow engineering specifications. ChR variants with large variations in off-kinetics (10 ms to >10s) and photocurrents that far exceed any of the parental or other commonly used ChRs were generated. The machine-learning models were also used to identify the residues and contacts most important for ChR function. For example, this machine-learning pipeline (data collection from diverse sequences, model training and validation, and prediction and testing of new sequences) can be used to refine other neuroscience tools, e.g., anion-conducting ChRs, calcium sensors, voltage sensors, and AAVs.

High-performance ChRs (e.g., ChRger1-3) with unprecedented light sensitivity are described herein for, e.g., in vivo optogenetics. The high-photocurrent properties of these ChRs can overcome the limitation of low per-cell copy number after systemic delivery. For example, as described herein, ChRger2 enabled neuronal excitation with high temporal precision without invasive intracranial surgery for virus delivery or fiber optic implantation for superficial brain areas, extending what is currently possible for optogenetics experiments All references cited herein, including patents, patent applications, papers, text books, and the like, and the references cited therein, to the extent that they are not already, are hereby incorporated herein by reference in their entirety. To the extent that any of the definitions or terms provided in the references incorporated by reference differ from the terms and discussion provided herein, the present terms and definitions control.

The foregoing written specification is considered to be sufficient to enable one skilled in the art to practice the invention. The foregoing description and examples detail certain preferred embodiments of the invention and describe the best mode contemplated by the inventors. It will be appreciated, however, that no matter how detailed the foregoing may appear in text, the invention may be practiced in many ways and the invention should be construed in accordance with the appended claims and any equivalents thereof.

In at least some of the previously described embodiments, one or more elements used in an embodiment can interchangeably be used in another embodiment unless such a replacement is not technically feasible. It will be appreciated by those skilled in the art that various other omissions, additions and modifications may be made to the methods and structures described above without departing from the scope of the claimed subject matter. All such modifications and changes are intended to fall within the scope of the subject matter, as defined by the appended claims.

With respect to the use of substantially any plural and/or singular terms herein, those having skill in the art can translate from the plural to the singular and/or from the singular to the plural as is appropriate to the context and/or application. The various singular/plural permutations may be expressly set forth herein for sake of clarity.

It will be understood by those within the art that, in general, terms used herein, and especially in the appended claims (e.g., bodies of the appended claims) are generally intended as "open" terms (e.g., the term "including" should be interpreted as "including but not limited to," the term "having" should be interpreted as "having at least," the term "includes" should be interpreted as "includes but is not limited to," etc.). It will be further understood by those within the art that if a specific number of an introduced claim recitation is intended, such an intent will be explicitly recited in the claim, and in the absence of such recitation no such intent is present. For example, as an aid to understanding, the following appended claims may contain usage of the introductory phrases "at least one" and "one or more" to introduce claim recitations. However, the use of such phrases should not be construed to imply that the introduction of a claim recitation by the indefinite articles "a" or "an" limits any particular claim containing such introduced claim recitation to embodiments containing only one such recitation, even when the same claim includes the introductory phrases "one or more" or "at least one" and indefinite articles such as "a" or "an" (e.g., "a" and/or "an" should be interpreted to mean "at least one" or "one or more"); the same holds true for the use of definite articles used to introduce claim recitations. In addition, even if a specific number of an introduced claim recitation is explicitly recited, those skilled in the art will recognize that such recitation should be interpreted to mean at least the recited number (e.g., the bare recitation of "two recitations," without other modifiers, means at least two recitations, or two or more recitations). Furthermore, in those instances where a convention analogous to "at least one of A, B, and C, etc." is used, in general such a construction is intended in the sense one having skill in the art would understand the convention (e.g., "a system having at least one of A, B, and C" would include but not be limited to systems that have A alone, B alone, C alone, A and B together, A and C together, B and C together, and/or A, B, and C together, etc.). In those instances where a convention analogous to "at least one of A, B, or C, etc." is used, in general such a construction is intended in the sense one having skill in the art would understand the convention (e.g., "a system having at least one of A, B, or C" would include but not be limited to systems that have A alone, B alone, C alone, A and B together, A and C together, B and C together, and/or A, B, and C together, etc.). It will be further understood by those within the art that virtually any disjunctive word and/or phrase presenting two or more alternative terms, whether in the description, claims, or drawings, should be understood to contemplate the possibilities of including one of the terms, either of the terms, or both terms. For example, the phrase "A or B" will be understood to include the possibilities of "A" or "B" or "A and B."

In addition, where features or aspects of the disclosure are described in terms of Markush groups, those skilled in the art will recognize that the disclosure is also thereby described in terms of any individual member or subgroup of members of the Markush group.

As will be understood by one skilled in the art, for any and all purposes, such as in terms of providing a written description, all ranges disclosed herein also encompass any and all possible sub-ranges and combinations of sub-ranges thereof. Any listed range can be easily recognized as sufficiently describing and enabling the same range being broken down into at least equal halves, thirds, quarters, fifths, tenths, etc. As a non-limiting example, each range discussed herein can be readily broken down into a lower third, middle third and upper third, etc. As will also be understood by one skilled in the art all language such as "up to," "at least," "greater than," "less than," and the like include the number recited and refer to ranges which can be subsequently broken down into sub-ranges as discussed above. Finally, as will be understood by one skilled in the art, a range includes each individual member. Thus, for example, a group having 1-3 articles refers to groups having 1, 2, or 3 articles. Similarly, a group having 1-5 articles refers to groups having 1, 2, 3, 4, or 5 articles, and so forth.

While various aspects and embodiments have been disclosed herein, other aspects and embodiments will be apparent to those skilled in the art. The various aspects and embodiments disclosed herein are for purposes of illustration and are not intended to be limiting, with the true scope and spirit being indicated by the following claims.

SEQUENCE LISTING (475 sequences)

SEQ ID NO: 1 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 2 - protein, 358 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEEDKV

SEQ ID NO: 3 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 4 - protein, 329 aa, Artificial Sequence
  Synthetic Polypeptide
MGGAPAPDAHSAPPGNDSAAHIVMVDAYKPTKGGSEYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEEDKV

SEQ ID NO: 5 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWLMFPGLFIFGPEGMHTLSPYANSIGHSICDIIAKEFWTFLAHHLRIKIHEHILIHGDIRKTTKMEIGGEEVEVEEFVEEEDEDTV

SEQ ID NO: 6 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHIIMYGDIRRPVSSQFLGRKVDVLAFVTEEDKV

SEQ ID NO: 7 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWITFALSALCLMFYGYQTWKSTCGWEEIYVATIEMIKFIIEYFHEFDSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 8 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSEPAVIYSSNGNKTVWLRYAEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 9 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDLGTICMGVTAALATGWVKWLFYCIGLVYGTQTFYNAGIIYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 10 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEAYHTVPKGRCRQVVTGMAWLFFVSWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 11 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGMFPILFILGPEGFGVLSPYANSIGHSICDIIAKEFWTFLAHHLRIKIHEHILIHGDIRKTTKMEIGGEEVEVEEFVEEEDEDTV

SEQ ID NO: 12 - protein, 359 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKLNIGGTEIEVETLVEDEAEAGAV

SEQ ID NO: 13 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTNAEKLAANILQWIAVFLSALFLAFYGWHAYKASVGWEEVYVCSVELIKVILEIYFEFTSPATVYLSTGNHAYCLRYFEWLLTCPVILIHLSNLTGLANDYNKRTMGLLVSCVGMIVFGMAAGLATDWLKWLLYIVSCIYGGYMYFQAAKCYVEAYHTVPKGRCRQVVTGMAWLFFVSWGSYPILWAVGPEGLLKLSVAGSTIGHTIADLLSKNIWGLLGHFLRIKIHEHIIMYGDIRRPVSSQFLGRKVDVLAFVTEEDKV

SEQ ID NO: 14 - protein, 358 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGALWEQETARGFQWFAVFLSALFLAFYGWHAYKASVGWEEVYVCSVELIKVILEIYFEFTEPAVIYSSGGNKTVWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEEDKV

SEQ ID NO: 15 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSGGNKTVWLRYAEWLLTCPVILIHLSNLTGLANDYNKRTMGLLVSDIGTIVWGTTAALATGWVKWLFYCIGLVYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 16 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMALLVSDIGTIVWGTTAALSKGYVRVIFFLMGLCYGTQTFYNAGIIYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 17 - protein, 358 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHIIMYGDIRRPVSSQFLGRKVDVLAFVTEEDKV

SEQ ID NO: 18 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVESYYIMPAGGCKKLVLAMTAVYYSSWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 19 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTPGEKIGAQVCQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 20 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNITGLSEAYNKRTMALLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 21 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTNAEKLAANILQWITVALSALCLMFYGWHAYKASVGWEEVYVCSVELIKVILEIYFEFTSPATVYLSGGNHAYCLRYFEWLLTCPVILIHLSNLSGLSEAYNKRTMGLIVSCVGMIVFGMAAGLATGWVKWLFYCIGLVYGIYTFFNAAKVYIEANHSVPKGRCRQVVTGMAWLFFVSWGMFPILFILGPEGFGVLSVYGSTVGHTIIDLMSKNCWGLLGHYLRVLIHEHILIHGDIRKTTKMEIGGEEVEVEEFVEEEDEDTV

SEQ ID NO: 22 - protein, 329 aa, Artificial Sequence
  Synthetic Polypeptide
MGGAPAPDAHSAPPGNDSAAHIVMVDAYKPTKGGSEYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNLTGLANDYNKRTMGLLVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEEDKV

SEQ ID NO: 23 - protein, 329 aa, Artificial Sequence
  Synthetic Polypeptide
MGGAPAPDAHSAPPGNDSAAHIVMVDAYKPTKGGSEYHAPAGYQVNPPYHPVHGYEEQCSSIYIYYGALWEQETARGFQWFAVFLSALFLAFYGWHAYKASVGWEEVYVCSVELIKVILEIYFEFTSPATVYLSTGNHAYCLRYFEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEEDKV

SEQ ID NO: 24 - protein, 329 aa, Artificial Sequence
  Synthetic Polypeptide
MGGAPAPDAHSAPPGNDSAAHIVMVDAYKPTKGGSEYHAPAGYQVNPPYHPVHGYEEQCSSIYIYYGALWEQETARGFQWFTFALSALCLMFYGYQTWKSTCGWEEIYVATIEMIKFIIEYFHEFDSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEEDKV

SEQ ID NO: 25 - protein, 329 aa, Artificial Sequence
  Synthetic Polypeptide
MGGAPAPDAHSAPPGNDSAAHIVMVDAYKPTKGGSEYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLSCPVILIRLSNLSGLKNDYSKRTMGLIVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEEDKV

SEQ ID NO: 26 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGALWEQETARGFQWFTFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 27 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDSPAMLFLYGGNITPWLRYAEWLLTCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 28 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTPGEKIGAQVCQWIAFSIAIALLTFYGYQTWKSTCGWEEIYVATIEMIKFIIEYFHEFDEPAVIYSSNGNKTVWLRYAEWLLTCPVILIRLSNLTGLANDYNKRTMGLLVSDIGTIVWGTTAALSKGYVRVIFFLMGLCYGIYTFFNAAKVYIEAYHTVPKGRCRQVVTGMAWLFFVSWGSYPILFILGPEGFGVLSPYANSIGHSICDIIAKEFWTFLAHYLRVLIHEHILIHGDIRKTTKLNIGGTEIEVETLVEDEAEAGAV

SEQ ID NO: 29 - protein, 358 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTPGEKIGAQVCQWIAFSIAIALLTFYGFSAWKATCGWEEVYVCCVEVLFVTLEIFKEFSSPATVYLSTGNHAYCLRYFEWLLTCPVILIHLSNLTGLANDYNKRTMGLLVSCVGMIVFGMAAGLATDWLKWLLYIVSCIYGGYMYFQAAKCYVEAYHTVPKGRCRQVVTGMAWLFFVSWLMFPGLFIFGPEGMHTLSVAGSTIGHTIADLLSKNIWGLLGHFLRIKIHEHIIMYGDIRRPVSSQFLGRKVDVLAFVTEEDKV

SEQ ID NO: 30 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEAYHTVPKGRCRQVVTGMAWLFFVSWGSYPILWAVGPEGLLKLSPYANSIGHSICDIIAKEFWTFLAHHLRIKIHEHILIHGDIRKTTKLNIGGTEIEVETLVEDEAEAGAV

SEQ ID NO: 31 - protein, 360 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKMEIGGEEVEVEEFVEEEDEDTV

SEQ ID NO: 32 - protein, 360 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 33 - protein, 329 aa, Artificial Sequence
  Synthetic Polypeptide
MGGAPAPDAHSAPPGNDSAAHIVMVDAYKPTKGGSEYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWGSYPILWAVGPEGLLKLSVAGSTIGHTIADLLSKNIWGLLGHFLRIKIHEHIIMYGDIRRPVSSQFLGRKVDVLAFVTEEDKV

SEQ ID NO: 34 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 35 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSCVGMIVFGMAAGLATDWLKWLLYIVSCIYGGYMYFQAAKCYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 36 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPAMLFLYGGNITPWLRYAEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 37 - protein, 329 aa, Artificial Sequence
  Synthetic Polypeptide
MGGAPAPDAHSAPPGNDSAAHIVMVDAYKPTKGGSEYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSCVGMIVFGMAAGLATDWLKWLLYIVSCIYGGYMYFQAAKCYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEEDKV

SEQ ID NO: 38 - protein, 329 aa, Artificial Sequence
  Synthetic Polypeptide
MGGAPAPDAHSAPPGNDSAAHIVMVDAYKPTKGGSEYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWGMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 39 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGFSAWKATCGWEEVYVCCVEVLFVTLEIFKEFSEPAVIYSSNGNKTVWLRYAEWLLSCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 40 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGHCRMVVKLMAYAYFASWGMFPILFILGPEGFGVLSVYGSTVGHTIIDLMSKNCWGLLGHHLRIKIHEHILIHGDIRKTTKLNIGGTEIEVETLVEDEAEAGAV

SEQ ID NO: 41 - protein, 329 aa, Artificial Sequence
  Synthetic Polypeptide
MGGAPAPDAHSAPPGNDSAAHIVMVDAYKPTKGGSEYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPCLRYFEWLLTCPVILIHLSNITGLSEAYNKRTMALIVSCVGMIVFGMAAGLATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEEDKV

SEQ ID NO: 42 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAVSIAIALLTFYGWHAYKASVGWEEVYVCSVELIKVILEIYFEFTSPATVYLSTGNHAYCLRYFEWLLTCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 43 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLSEAYNKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 44 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNITGLKNDYSKRTMGLIVSCVGMIVFGMAAGLATDWLKWLLYIVSCIYGGYMYFQAAKCYVESYYIMPKGHCRMVVKLMAYAYFASWGSYPILWAVGPEGLLKLSPYANSIGHSICDIIAKEFWTFLAHHLRIKIHEHIIMYGDIRRPVSSQFLGRKVDVLAFVTEEDKV

SEQ ID NO: 45 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLSEAYNKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 46 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPAGGCKKLVLAMTAVYYSSWLSYPILWAVGPEGLLKLSPYANSIGHSICDIIAKEFWTFLAHFLRIKIHEHILIHGDIRKTTKMEIGGEEVEVEEFVEEEDEDTV

SEQ ID NO: 47 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSGGNHAYCLRYFEWLLSCPVILIRLSNLSGLKNDYSKRTMGLIVSCVGMIVFGMAAGLATGWVKWLFYCIGLVYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 48 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMALIVSCVGMIVFGMAAGLATDWLKWLLYIVSCIYGTQTFYNAGIIYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 49 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILFILGPEGFGVLSPYANSIGHSICDIIAKEFWTFLAHHLRIKIHEHILIHGDIRKTTKMEIGGEEVEVEEFVEEEDEDTV

SEQ ID NO: 50 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLANDYNKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 51 - protein, 359 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLTGLKNDYSKRTMGLIVSCVGMIVFGMAAGLATDWLKWLLYIVSCIYGGYMYFQAAKCYVEAYHTVPKGHCRMVVKLMAYAYFASWGSYPILWAVGPEGLLKLSPYANSIGHSICDIIAKEFWTFLAHHLRIKIHEHILIHGDIRKTTKLNIGGTEIEVETLVEDEAEAGAV

SEQ ID NO: 52 - protein, 358 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNITGLANDYNKRTMGLLVSDIGTIVWGTTAALSKGYVRVIFFLMGLCYGIYTFFNAAKVYIESYYIMPKGRCRQVVTGMAWLFFVSWGMFPILFILGPEGFGVLSVYGSTVGHTIIDLMSKNCWGLLGHYLRVLIHEHIIMYGDIRRPVSSQFLGRKVDVLAFVTEEDKV

SEQ ID NO: 53 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGRCRQVVTGMAWLFFVSWGSYPILWAVGPEGLLKLSPYANSIGHSICDIIAKEFWTFLAHYLRVLIHEHILIHGDIRKTTKMEIGGEEVEVEEFVEEEDEDTV

SEQ ID NO: 54 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSNGNHAYCLRYFEWLLSCPVILIRLSNLSGLKNDYSKRTMGLIVSCVGMIVFGMAAGLSKGYVRVIFFLMGLCYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 55 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGIYTFFNAAKVYIEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 56 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFAVFLSALFLAFYGWHAYKASVGWEEVYVCSVELIKVILEIYFEFTSPATVYLSGGNHAYWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEEDKV

SEQ ID NO: 57 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLKNDYSKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 58 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITVALSALCLMFYGWHAYKASVGWEEVYVCSVELIKVILEIYFEFTEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 59 - protein, 329 aa, Artificial Sequence
  Synthetic Polypeptide
MGGAPAPDAHSAPPGNDSAAHIVMVDAYKPTKGGSEYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLKNDYSKRTMALLVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEEDKV

SEQ ID NO: 60 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVCLRYFEWLLTCPVILIHLSNLTGLANDYNKRTMGLIVSCVGMIVFGMAAGLSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 61 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSTGNKTVWLRYAEWLLTCPVILIHLSNLTGLANDYNKRTMGLLVSDIGTIVWGTTAALATDWLKWLLYIVSCIYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 62 - protein, 360 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTPGEKIGAQVCQWIAFSIAIALLTFYGFSAWKATCGWEEVYVCCVEVLFVTLEIFKEFSEPAVIYSSTGNKTVCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 63 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGGYMYFQAAKCYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 64 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTPGEKIGAQVCQWIAFSIAIALLTFYGYQTWKSTCGWEEIYVATIEMIKFIIEYFHEFDEPAVIYSSNGNKTVCLRYFEWLLTCPVILIRLSNLTGLKNDYSKRTMGLIVSCVGMIVFGMAAGLSKGYVRVIFFLMGLCYGGYMYFQAAKCYVEAYHTVPKGRCRQVVTGMAWLFFVSWGSYPILWAVGPEGLLKLSPYANSIGHSICDIIAKEFWTFLAHYLRVLIHEHILIHGDIRKTTKLNIGGTEIEVETLVEDEAEAGAV

SEQ ID NO: 65 - protein, 358 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSTGNKTVCLRYFEWLLTCPVILIHLSNITGLKNDYSKRTMGLIVSCVGMIVFGMAAGLATDWLKWLLYIVSCIYGGYMYFQAAKCYVESYYIMPAGGCKKLVLAMTAVYYSSWLMFPILWAVGPEGLLKLSVYGSTVGHTIIDLMSKNCWGLLGHFLRIKIHEHIIMYGDIRRPVSSQFLGRKVDVLAFVTEEDKV

SEQ ID NO: 66 - protein, 358 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGALWEQETARGFQWFAFFLSALFLAFYGFSAWKATCGWEEVYVCCVEVLFVTLEIFKEFSEPAVIYSSNGNKTVCLRYFEWLLSCPVILIHLSNITGLKNDYSKRTMGLIVSCVGMIVFGMAAGLSKGYVRVIFFLMGLCYGIYTFFNAAKVYIESYYIMPKGRCRQVVTGMAWLFFVSWGMFPILFILGPEGFGVLSVAGSTIGHTIADLLSKNIWGLLGHYLRVLIHEHIIMYGDIRRPVSSQFLGRKVDVLAFVTEEDKV

SEQ ID NO: 67 - protein, 329 aa, Artificial Sequence
  Synthetic Polypeptide
MGGAPAPDAHSAPPGNDSAAHIVMVDAYKPTKGGSEYHAPAGYQVNPPYHPVHGYEEQCSSIYIYYGALWEQETARGFQWFAFFLSALFLAFYGYQTWKSTCGWEEIYVATIEMIKFIIEYFHEFDSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEEDKV

SEQ ID NO: 68 - protein, 329 aa, Artificial Sequence
  Synthetic Polypeptide
MGGAPAPDAHSAPPGNDSAAHIVMVDAYKPTKGGSEYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWLMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 69 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGALWEQETARGFQWFAFFLSALFLAFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVAGSTIGHTIADLLSKNIWGLLGHYLRVLIHEHILIHGDIRKTTKLNIGGTEIEVETLVEDEAEAGAV

SEQ ID NO: 70 - protein, 332 aa, Artificial Sequence
  Synthetic Polypeptide
MGGAPAPDAHSAPPGNDSAAHIVMVDAYKPTKGGSEYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNLTGLSEAYNKRTMALLVSDLGTICMGVTAALATGWVKWLFYCIGLVYGTQTFYNAGIIYVEAYHTVPAGGCKKLVLAMTAVYYSSWLMFPGLFIFGPEGMHTLSVAGSTIGHTIADLLSKNIWGLLGHFLRIKIHEHILIHGDIRKTTKLNIGGTEIEVETLVEDEAEAGAV

SEQ ID NO: 71 - protein, 329 aa, Artificial Sequence
  Synthetic Polypeptide
MGGAPAPDAHSAPPGNDSAAHIVMVDAYKPTKGGSEYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPKGRCRQVVTGMAWLFFVSWGMFPGLFIFGPEGMHTLSVAGSTIGHTIADLLSKNIWGLLGHYLRVLIHEHIIMYGDIRRPVSSQFLGRKVDVLAFVTEEDKV

SEQ ID NO: 72 - protein, 329 aa, Artificial Sequence
  Synthetic Polypeptide
MGGAPAPDAHSAPPGNDSAAHIVMVDAYKPTKGGSEYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDIGTIVWGTTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEEDKV

SEQ ID NO: 73 - protein, 329 aa, Artificial Sequence
  Synthetic Polypeptide
MGGAPAPDAHSAPPGNDSAAHIVMVDAYKPTKGGSEYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYNGNITPWLRYAEWLLTCPVILIHLSNITGLSEAYNKRTMALLVSDLGTICMGVTAALSKGYVRVIFFLMGLCYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEEDKV

SEQ ID NO: 74 - protein, 329 aa, Artificial Sequence
  Synthetic Polypeptide
MGGAPAPDAHSAPPGNDSAAHIVMVDAYKPTKGGSEYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWLMFPILWAVGPEGLLKLSVAGSTIGHTIADLLSKNIWGLLGHFLRIKIHEHIIMYGDIRRPVSSQFLGRKVDVLAFVTEEDKV

SEQ ID NO: 75 - protein, 329 aa, Artificial Sequence
  Synthetic Polypeptide
MGGAPAPDAHSAPPGNDSAAHIVMVDAYKPTKGGSEYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLANDYNKRTMALLVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEEDKV

SEQ ID NO: 76 - protein, 329 aa, Artificial Sequence
  Synthetic Polypeptide
MGGAPAPDAHSAPPGNDSAAHIVMVDAYKPTKGGSEYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWLMFPGLFIFGPEGMHTLSVAGSTIGHTIADLLSKNIWGLLGHFLRIKIHEHIIMYGDIRRPVSSQFLGRKVDVLAFVTEEDKV

SEQ ID NO: 77 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTPGEKIGAQVCQWIAFSIAIALLTFYGYQTWKSTCGWEEIYVATIEMIKFIIEYFHEFDEPAVIYSSNGNKTVCLRYFEWLLTCPVILIRLSNLTGLANDYNKRTMGLIVSCVGMIVFGMAAGLSKGYVRVIFFLMGLCYGGYMYFQAAKCYVEAYHTVPKGRCRQVVTGMAWLFFVSWGSYPGLFIFGPEGMHTLSPYANSIGHSICDIIAKEFWTFLAHYLRVLIHEHILIHGDIRKTTKLNIGGTEIEVETLVEDEAEAGAV

SEQ ID NO: 78 - protein, 359 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEAYHTVPKGRCRQVVTGMAWLFFVSWGSYPILWAVGPEGLLKLSPYANSIGHSICDIIAKEFWTFLAHHLRIKIHEHILIHGDIRKTTKLNIGGTEIEVETLVEDEAEAGAV

SEQ ID NO: 79 - protein, 359 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGYQTWKSTCGWEEIYVATIEMIKFIIEYFHEFDSPATVYLSNGNHAYCLRYFEWLLTCPVILIRLSNLTGLANDYNKRTMGLIVSCVGMIVFGMAAGLSKGYVRVIFFLMGLCYGGYMYFQAAKCYVEAYHTVPKGRCRQVVTGMAWLFFVSWGSYPILWAVGPEGLLKLSPYANSIGHSICDIIAKEFWTFLAHYLRVLIHEHILIHGDIRKTTKLNIGGTEIEVETLVEDEAEAGAV

SEQ ID NO: 80 - protein, 359 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLTGLKNDYSKRTMGLIVSCVGMIVFGMAAGLATDWLKWLLYIVSCIYGGYMYFQAAKCYVEAYHTVPKGHCRMVVKLMAYAYFASWGSYPILFILGPEGFGVLSPYANSIGHSICDIIAKEFWTFLAHHLRIKIHEHILIHGDIRKTTKLNIGGTEIEVETLVEDEAEAGAV

SEQ ID NO: 81 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEAYHTVPKGRCRQVVTGMAWLFFVSWGSYPILWAVGPEGLLKLSPYANSIGHSICDIIAKEFWTFLAHHLRIKIHEHIIMYGDIRRPVSSQFLGRKVDVLAFVTEEDKV

SEQ ID NO: 82 - protein, 358 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGALWEQETARGFQWFAFSIAIALLTFYGFSAWKATCGWEEVYVCCVEVLFVTLEIFKEFSSPATVYLSTGNHAYCLRYFEWLLTCPVILIHLSNLTGLANDYNKRTMGLLVSCVGMIVFGMAAGLATDWLKWLLYIVSCIYGGYMYFQAAKCYVESYYIMPAGGCKKLVLAMTAVYYSSWGMFPILFILGPEGFGVLSPYANSIGHSICDIIAKEFWTFLAHHLRIKIHEHIIMYGDIRRPVSSQFLGRKVDVLAFVTEEDKV

SEQ ID NO: 83 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSGGNHAYCLRYFEWLLSCPVILIRLSNITGLANDYNKRTMGLIVSCVGMIVFGMAAGLATGWVKWLFYCIGLVYGIYTFFNAAKVYIESYYIMPKGRCRQVVTGMAWLFFVSWGSYPGLFIFGPEGMHTLSPYANSIGHSICDIIAKEFWTFLAHYLRVLIHEHIIMYGDIRRPVSSQFLGRKVDVLAFVTEEDKV

SEQ ID NO: 84 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTNAEKLAANILQWIAFSIAIALLTFYGFSAWKATCGWEEVYVCCVEVLFVTLEIFKEFSEPAVIYSSNGNKTVWLRYAEWLLTCPVILIHLSNITGLSEAYNKRTMALLVSCVGMIVFGMAAGLATDWLKWLLYIVSCIYGGYMYFQAAKCYVEAYHTVPKGRCRQVVTGMAWLFFVSWGMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 85 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAVFLSALFLAFYGWHAYKASVGWEEVYVCSVELIKVILEIYFEFTSPATVYLSTGNHAYCLRYFEWLLTCPVILIHLSNLTGLANDYNKRTMGLLVSCVGMIVFGMAAGLATDWLKWLLYIVSCIYGGYMYFQAAKCYVEAYHTVPKGRCRQVVTGMAWLFFVSWGMFPILFILGPEGFGVLSPYANSIGHSICDIIAKEFWTFLAHHLRIKIHEHIIMYGDIRRPVSSQFLGRKVDVLAFVTEEDKV

SEQ ID NO: 86 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFTFALSALCLMFYGYQTWKSTCGWEEIYVATIEMIKFIIEYFHEFDSPATVYLSTGNHAYCLRYFEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWGSYPILWAVGPEGLLKLSVAGSTIGHTIADLLSKNIWGLLGHFLRIKIHEHIIMYGDIRRPVSSQFLGRKVDVLAFVTEEDKV

SEQ ID NO: 87 - protein, 360 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGALWEQETARGFQWFTFALSALCLMFYGYQTWKSTCGWEEIYVATIEMIKFIIEYFHEFDSPATVYLSTGNHAYCLRYFEWLLTCPVILIHLSNITGLSEAYNKRTMALLVSCVGMIVFGMAAGLATDWLKWLLYIVSCIYGGYMYFQAAKCYVEAYHTVPKGRCRQVVTGMAWLFFVSWLMFPGLFIFGPEGMHTLSVAGSTIGHTIADLLSKNIWGLLGHFLRIKIHEHILIHGDIRKTTKMEIGGEEVEVEEFVEEEDEDTV

SEQ ID NO: 88 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFTFALSALCLMFYGYQTWKSTCGWEEIYVATIEMIKFIIEYFHEFDEPAVIYSSNGNKTVWLRYAEWLLSCPVILIRLSNLSGLKNDYSKRTMGLIVSCVGMIVFGMAAGLATDWLKWLLYIVSCIYGGYMYFQAAKCYVEAYHTVPKGRCRQVVTGMAWLFFVSWGSYPILWAVGPEGLLKLSPYANSIGHSICDIIAKEFWTFLAHHLRIKIHEHIIMYGDIRRPVSSQFLGRKVDVLAFVTEEDKV

SEQ ID NO: 89 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAVSIAIALLTFYGWHAYKASVGWEEVYVCSVELIKVILEIYFEFTSPATVYLSNGNHAYCLRYFEWLLTCPVILIRLSNITGLANDYNKRTMGLIVSCVGMIVFGMAAGLSKGYVRVIFFLMGLCYGGYMYFQAAKCYVESYYIMPKGHCRMVVKLMAYAYFASWGSYPILWAVGPEGLLKLSPYANSIGHSICDIIAKEFWTFLAHHLRIKIHEHIIMYGDIRRPVSSQFLGRKVDVLAFVTEEDKV

SEQ ID NO: 90 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFAFFLSALFLAFYGYQTWKSTCGWEEIYVATIEMIKFIIEYFHEFDSPATVYLSTGNHAYCLRYFEWLLTCPVILIHLSNITGLSEAYNKRTMALIVSCVGMIVFGMAAGLATDWLKWLLYIVSCIYGTQTFYNAGIIYVESYYIMPKGRCRQVVTGMAWLFFVSWGMFPILFILGPEGFGVLSVAGSTIGHTIADLLSKNIWGLLGHYLRVLIHEHIIMYGDIRRPVSSQFLGRKVDVLAFVTEEDKV

SEQ ID NO: 91 - protein, 359 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGYQTWKSTCGWEEIYVATIEMIKFIIEYFHEFDSPATVYLSNGNHAYCLRYFEWLLTCPVILIRLSNLTGLSEAYNKRTMGLIVSCVGMIVFGMAAGLSKGYVRVIFFLMGLCYGGYMYFQAAKCYVEAYHTVPAGGCKKLVLAMTAVYYSSWLSYPGLFIFGPEGMHTLSPYANSIGHSICDIIAKEFWTFLAHFLRIKIHEHILIHGDIRKTTKLNIGGTEIEVETLVEDEAEAGAV

SEQ ID NO: 92 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTPGEKIGAQVCQWITFALSALCLMFYGYQTWKSTCGWEEIYVATIEMIKFIIEYFHEFDSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDEAEAGAV

SEQ ID NO: 93 - protein, 359 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFAFSIAIALLTFYGFSAWKATCGWEEVYVCCVEVLFVTLEIFKEFSSPAMLFLYGGNITPWLRYAEWLLTCPVILIHLSNLTGLANDYNKRTMGLLVSCVGMIVFGMAAGLATDWLKWLLYIVSCIYGGYMYFQAAKCYVEAYHTVPKGRCRQVVTGMAWLFFVSWGSYPILWAVGPEGLLKLSVAGSTIGHTIADLLSKNIWGLLGHFLRIKIHEHILIHGDIRKTTKLNIGGTEIEVETLVEDEAEAGAV

SEQ ID NO: 94 - protein, 329 aa, Artificial Sequence
  Synthetic Polypeptide
MGGAPAPDAHSAPPGNDSAAHIVMVDAYKPTKGGSEYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYTGNITPCLRYFEWLLTCPVILIHLSNITGLSEAYNKRTMALIVSCVGMIVFGMAAGLATDWLKWLLYIVSCIYGTQTFYNAGIIYVESYYIMPKGHCRMVVKLMAYAYFASWGMFPILFILGPEGFGVLSVAGSTIGHTIADLLSKNIWGLLGHHLRIKIHEHIIMYGDIRRPVSSQFLGRKVDVLAFVTEEDKV

SEQ ID NO: 95 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSGGNHAYCLRYFEWLLSCPVILIRLSNLSGLSEAYNKRTMGLIVSCVGMIVFGMAAGLATGWVKWLFYCIGLVYGIYTFFNAAKVYIEANHSVPKGRCRQVVTGMAWLFFVSWGSYPILFILGPEGFGVLSPYANSIGHSICDIIAKEFWTFLAHYLRVLIHEHILIHGDIRKTTKMEIGGEEVEVEEFVEEEDEDTV

SEQ ID NO: 96 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTNAEKLAANILQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVESYYIMPAGGCKKLVLAMTAVYYSSWLMFPGLFIFGPEGMHTLSPYANSIGHSICDIIAKEFWTFLAHHLRIKIHEHILIHGDIRKTTKMEIGGEEVEVEEFVEEEDEDTV

SEQ ID NO: 97 - protein, 359 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFAFSIAIALLTFYGFSAWKATCGWEEVYVCCVEVLFVTLEIFKEFSSPAMLFLYGGNITPWLRYAEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGMFPILFILGPEGFGVLSPYANSIGHSICDIIAKEFWTFLAHHLRIKIHEHILIHGDIRKTTKLNIGGTEIEVETLVEDEAEAGAV

SEQ ID NO: 98 - protein, 329 aa, Artificial Sequence
  Synthetic Polypeptide
MGGAPAPDAHSAPPGNDSAAHIVMVDAYKPTKGGSEYHAPAGYQVNPPYHPVHGYEEQCSSIYIYYGTPGEKIGAQVCQWIAVFLSALFLAFYGWHAYKASVGWEEVYVCSVELIKVILEIYFEFTEPAVIYSSNGNKTVWLRYAEWLLSCPVILIRLSNLSGLKNDYSKRTMGLIVSDLGTICMGVTAALATGWVKWLFYCIGLVYGTQTFYNAGIIYVESYYIMPAGGCKKLVLAMTAVYYSSWGMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 99 - protein, 359 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGYQTWKSTCGWEEIYVATIEMIKFIIEYFHEFDSPATVYLSGGNHAYCLRYFEWLLTCPVILIRLSNLTGLANDYNKRTMGLIVSCVGMIVFGMAAGLATGWVKWLFYCIGLVYGGYMYFQAAKCYVEAYHTVPKGHCRMVVKLMAYAYFASWGSYPILFILGPEGFGVLSPYANSIGHSICDIIAKEFWTFLAHHLRIKIHEHILIHGDIRKTTKLNIGGTEIEVETLVEDEAEAGAV

SEQ ID NO: 100 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVESYYIMPAGGCKKLVLAMTAVYYSSWGMFPILFILGPEGFGVLSPYANSIGHSICDIIAKEFWTFLAHHLRIKIHEHIIMYGDIRRPVSSQFLGRKVDVLAFVTEEDKV

SEQ ID NO: 101 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGYQTWKSTCGWEEIYVATIEMIKFIIEYFHEFDSPATVYLSTGNHAYCLRYFEWLLTCPVILIRLSNITGLANDYNKRTMGLIVSCVGMIVFGMAAGLATDWLKWLLYIVSCIYGGYMYFQAAKCYVESYYIMPKGHCRMVVKLMAYAYFASWGSYPILFILGPEGFGVLSPYANSIGHSICDIIAKEFWTFLAHHLRIKIHEHIIMYGDIRRPVSSQFLGRKVDVLAFVTEEDKV

SEQ ID NO: 102 - protein, 360 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 103 - protein, 358 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTPGEKIGAQVCQWIAVFLSALFLAFYGWHAYKASVGWEEVYVCSVELIKVILEIYFEFTSPATVYLSTGNHAYCLRYFEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 104 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFAFFLSALFLAFYGYQTWKSTCGWEEIYVATIEMIKFIIEYFHEFDSPATVYLSGGNHAYCLRYFEWLLTCPVILIHLSNITGLKNDYSKRTMGLIVSCVGMIVFGMAAGLATGWVKWLFYCIGLVYGGYMYFQAAKCYVESYYIMPKGRCRQVVTGMAWLFFVSWGMFPILFILGPEGFGVLSVAGSTIGHTIADLLSKNIWGLLGHYLRVLIHEHIIMYGDIRRPVSSQFLGRKVDVLAFVTEEDKV

SEQ ID NO: 105 - protein, 359 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFAFFLSALFLAFYGYQTWKSTCGWEEIYVATIEMIKFIIEYFHEFDSPATVYLSGGNHAYCLRYFEWLLTCPVILIHLSNLTGLSEAYNKRTMGLIVSCVGMIVFGMAAGLATGWVKWLFYCIGLVYGIYTFFNAAKVYIEAYHTVPKGRCRQVVTGMAWLFFVSWGMFPILFILGPEGFGVLSVAGSTIGHTIADLLSKNIWGLLGHYLRVLIHEHILIHGDIRKTTKLNIGGTEIEVETLVEDEAEAGAV

SEQ ID NO: 106 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFAVFLSALFLAFYGWHAYKASVGWEEVYVCSVELIKVILEIYFEFTSPATVYLSNGNHAYCLRYFEWLLTCPVILIHLSNITGLSEAYNKRTMGLIVSCVGMIVFGMAAGLSKGYVRVIFFLMGLCYGGYMYFQAAKCYVESYYIMPKGRCRQVVTGMAWLFFVSWGMFPILFILGPEGFGVLSVAGSTIGHTIADLLSKNIWGLLGHYLRVLIHEHIIMYGDIRRPVSSQFLGRKVDVLAFVTEEDKV

SEQ ID NO: 107 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFAVFLSALFLAFYGWHAYKASVGWEEVYVCSVELIKVILEIYFEFTSPATVYLSTGNHAYCLRYFEWLLTCPVILIHLSNITGLKNDYSKRTMGLIVSCVGMIVFGMAAGLATDWLKWLLYIVSCIYGIYTFFNAAKVYIESYYIMPAGGCKKLVLAMTAVYYSSWLMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 108 - protein, 359 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSGGNHAYCLRYFEWLLSCPVILIRLSNLTGLSEAYNKRTMALIVSCVGMIVFGMAAGLATGWVKWLFYCIGLVYGTQTFYNAGIIYVEAYHTVPKGRCRQVVTGMAWLFFVSWGSYPILWAVGPEGLLKLSPYANSIGHSICDIIAKEFWTFLAHYLRVLIHEHILIHGDIRKTTKLNIGGTEIEVETLVEDEAEAGAV

SEQ ID NO: 109 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 110 - protein, 359 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGYQTWKSTCGWEEIYVATIEMIKFIIEYFHEFDSPATVYLSTGNHAYCLRYFEWLLTCPVILIRLSNLTGLSEAYNKRTMALIVSCVGMIVFGMAAGLATDWLKWLLYIVSCIYGTQTFYNAGIIYVEAYHTVPKGRCRQVVTGMAWLFFVSWGSYPILFILGPEGFGVLSPYANSIGHSICDIIAKEFWTFLAHYLRVLIHEHILIHGDIRKTTKLNIGGTEIEVETLVEDEAEAGAV

SEQ ID NO: 111 - protein, 358 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGALWEQETARGFQWFAVFLSALFLAFYGWHAYKASVGWEEVYVCSVELIKVILEIYFEFTEPAVIYSSGGNKTVWLRYAEWLLTCPVILIHLSNITGLSEAYNKRTMGLLVSDLGTICMGVTAALATGWVKWLFYCIGLVYGGYMYFQAAKCYVESYYIMPKGRCRQVVTGMAWLFFVSWGMFPILFILGPEGFGVLSVAGSTIGHTIADLLSKNIWGLLGHYLRVLIHEHIIMYGDIRRPVSSQFLGRKVDVLAFVTEEDKV

SEQ ID NO: 112 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFAVFLSALFLAFYGWHAYKASVGWEEVYVCSVELIKVILEIYFEFTSPATVYLSGGNHAYCLRYFEWLLTCPVILIHLSNITGLKNDYSKRTMGLIVSCVGMIVFGMAAGLATGWVKWLFYCIGLVYGIYTFFNAAKVYIESYYIMPKGRCRQVVTGMAWLFFVSWGMFPILWAVGPEGLLKLSVAGSTIGHTIADLLSKNIWGLLGHYLRVLIHEHIIMYGDIRRPVSSQFLGRKVDVLAFVTEEDKV

SEQ ID NO: 113 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFAFFLSALFLAFYGFSAWKATCGWEEVYVCCVEVLFVTLEIFKEFSSPATVYLSGGNHAYCLRYFEWLLSCPVILIHLSNITGLSEAYNKRTMGLIVSCVGMIVFGMAAGLATGWVKWLFYCIGLVYGGYMYFQAAKCYVESYYIMPAGGCKKLVLAMTAVYYSSWLMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 114 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTNAEKLAANILQWITFALSALCLMFYGYQTWKSTCGWEEIYVATIEMIKFIIEYFHEFDSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEAYHTVPKGRCRQVVTGMAWLFFVSWGMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 115 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFTFALSALCLMFYGYQTWKSTCGWEEIYVATIEMIKFIIEYFHEFDSPATVYLSTGNHAYCLRYFEWLLTCPVILIHLSNITGLSEAYNKRTMALLVSCVGMIVFGMAAGLATDWLKWLLYIVSCIYGGYMYFQAAKCYVEAYHTVPKGRCRQVVTGMAWLFFVSWGMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 116 - protein, 359 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAVSIAIALLTFYGWHAYKASVGWEEVYVCSVELIKVILEIYFEFTSPATVYLSGGNHAYCLRYFEWLLTCPVILIRLSNLTGLKNDYSKRTMGLIVSCVGMIVFGMAAGLATGWVKWLFYCIGLVYGIYTFFNAAKVYIEAYHTVPKGRCRQVVTGMAWLFFVSWGSYPILFILGPEGFGVLSPYANSIGHSICDIIAKEFWTFLAHYLRVLIHEHILIHGDIRKTTKLNIGGTEIEVETLVEDEAEAGAV

SEQ ID NO: 117 - protein, 358 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGALWEQETARGFQWFTFALSALCLMFYGYQTWKSTCGWEEIYVATIEMIKFIIEYFHEFDSPATVYLSTGNHAYCLRYFEWLLTCPVILIHLSNLTGLANDYNKRTMGLLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 118 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSGGNHAYCLRYFEWLLSCPVILIRLSNITGLSEAYNKRTMGLIVSCVGMIVFGMAAGLATGWVKWLFYCIGLVYGIYTFFNAAKVYIESYYIMPKGHCRMVVKLMAYAYFASWGSYPILFILGPEGFGVLSPYANSIGHSICDIIAKEFWTFLAHHLRIKIHEHIIMYGDIRRPVSSQFLGRKVDVLAFVTEEDKV

SEQ ID NO: 119 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDSPATVYLSTGNHAYCLRYFEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDEAEAGAV

SEQ ID NO: 120 - protein, 358 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTPGEKIGAQVCQWITFALSALCLMFYGYQTWKSTCGWEEIYVATIEMIKFIIEYFHEFDEPAVIYSSNGNKTVWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 121 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFAVFLSALFLAFYGWHAYKASVGWEEVYVCSVELIKVILEIYFEFTSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEAYHTVPKGRCRQVVTGMAWLFFVSWGMFPILFILGPEGFGVLSPYANSIGHSICDIIAKEFWTFLAHHLRIKIHEHIIMYGDIRRPVSSQFLGRKVDVLAFVTEEDKV

SEQ ID NO: 122 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFAFFLSALFLAFYGFSAWKATCGWEEVYVCCVEVLFVTLEIFKEFSSPATVYLSTGNHAYCLRYFEWLLSCPVILIHLSNITGLANDYNKRTMALIVSCVGMIVFGMAAGLATDWLKWLLYIVSCIYGTQTFYNAGIIYVESYYIMPKGRCRQVVTGMAWLFFVSWGMFPILFILGPEGFGVLSVAGSTIGHTIADLLSKNIWGLLGHYLRVLIHEHIIMYGDIRRPVSSQFLGRKVDVLAFVTEEDKV

SEQ ID NO: 123 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGYQTWKSTCGWEEIYVATIEMIKFIIEYFHEFDSPATVYLSGGNHAYCLRYFEWLLTCPVILIRLSNITGLKNDYSKRTMALIVSCVGMIVFGMAAGLATGWVKWLFYCIGLVYGTQTFYNAGIIYVESYYIMPKGRCRQVVTGMAWLFFVSWGSYPILFILGPEGFGVLSPYANSIGHSICDIIAKEFWTFLAHYLRVLIHEHIIMYGDIRRPVSSQFLGRKVDVLAFVTEEDKV

SEQ ID NO: 124 - protein, 359 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLTGLANDYNKRTMGLIVSCVGMIVFGMAAGLATDWLKWLLYIVSCIYGIYTFFNAAKVYIEAYHTVPAGGCKKLVLAMTAVYYSSWLSYPILFILGPEGFGVLSPYANSIGHSICDIIAKEFWTFLAHFLRIKIHEHILIHGDIRKTTKLNIGGTEIEVETLVEDEAEAGAV

SEQ ID NO: 125 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDEAEAGAV

SEQ ID NO: 126 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSGGNKTVWLRYAEWLLTCPVILIHLSNLTGLANDYNKRTMGLLVSDLGTICMGVTAALATGWVKWLFYCIGLVYGGYMYFQAAKCYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 127 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTPGEKIGAQVCQWITFALSALCLMFYGYQTWKSTCGWEEIYVATIEMIKFIIEYFHEFDEPAVIYSSNGNKTVWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDEAEAGAV

SEQ ID NO: 128 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSGGNKTVWLRYAEWLLTCPVILIHLSNLTGLANDYNKRTMALLVSDIGTIVWGTTAALATGWVKWLFYCIGLVYGTQTFYNAGIIYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 129 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGALWEQETARGFQWFAFFLSALFLAFYGYQTWKSTCGWEEIYVATIEMIKFIIEYFHEFDEPAVIYSSGGNKTVWLRYAEWLLTCPVILIHLSNLTGLANDYNKRTMALLVSDIGTIVWGTTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHYLRVLIHEHILIHGDIRKTTKLNIGGTEIEVETLVEDEAEAGAV

SEQ ID NO: 130 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSGGNKTVWLRYAEWLLTCPVILIHLSNLTGLANDYNKRTMGLLVSDIGTIVWGTTAALATGWVKWLFYCIGLVYGGYMYFQAAKCYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 131 - protein, 358 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGALWEQETARGFQWFAVFLSALFLAFYGWHAYKASVGWEEVYVCSVELIKVILEIYFEFTEPAVIYSSGGNKTVWLRYAEWLLTCPVILIHLSNITGLKNDYSKRTMGLLVSDLGTICMGVTAALATGWVKWLFYCIGLVYGGYMYFQAAKCYVESYYIMPKGRCRQVVTGMAWLFFVSWGMFPILFILGPEGFGVLSVAGSTIGHTIADLLSKNIWGLLGHYLRVLIHEHIIMYGDIRRPVSSQFLGRKVDVLAFVTEEDKV

SEQ ID NO: 132 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFAVFLSALFLAFYGWHAYKASVGWEEVYVCSVELIKVILEIYFEFTSPATVYLSGGNHAYWLRYAEWLLTCPVILIHLSNITGLANDYNKRTMALLVSDLGTICMGVTAALATGWVKWLFYCIGLVYGTQTFYNAGIIYVESYYIMPAGGCKKLVLAMTAVYYSSWLMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 133 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSGGNKTVWLRYAEWLLTCPVILIHLSNLTGLKNDYSKRTMALLVSDIGTIVWGTTAALATGWVKWLFYCIGLVYGTQTFYNAGIIYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 134 - protein, 360 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEAYHTVPKGRCRQVVTGMAWLFFVSWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 135 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFAVFLSALFLAFYGWHAYKASVGWEEVYVCSVELIKVILEIYFEFTSPATVYLSGGNHAYWLRYAEWLLTCPVILIHLSNITGLSEAYNKRTMALLVSDLGTICMGVTAALATGWVKWLFYCIGLVYGTQTFYNAGIIYVESYYIMPKGRCRQVVTGMAWLFFVSWGMFPILFILGPEGFGVLSVAGSTIGHTIADLLSKNIWGLLGHYLRVLIHEHIIMYGDIRRPVSSQFLGRKVDVLAFVTEEDKV

SEQ ID NO: 136 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDEAEAGAV

SEQ ID NO: 137 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGALWEQETARGFQWFAFFLSALFLAFYGYQTWKSTCGWEEIYVATIEMIKFIIEYFHEFDEPAVIYSSGGNKTVWLRYAEWLLTCPVILIHLSNLTGLANDYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHYLRVLIHEHILIHGDIRKTTKLNIGGTEIEVETLVEDEAEAGAV

SEQ ID NO: 138 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFAVFLSALFLAFYGWHAYKASVGWEEVYVCSVELIKVILEIYFEFTSPATVYLSGGNHAYWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWLMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 139 - protein, 358 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWGMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 140 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTPGEKIGAQVCQWITFALSALCLMFYGYQTWKSTCGWEEIYVATIEMIKFIIEYFHEFDSPAMLFLYGGNITPWLRYAEWLLTCPVILIHLSNITGLSEAYNKRTMALLVSCVGMIVFGMAAGLATDWLKWLLYIVSCIYGGYMYFQAAKCYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDEAEAGAV

SEQ ID NO: 141 - protein, 360 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEAYHTVPKGRCRQVVTGMAWLFFVSWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 142 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWGMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 143 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFAVFLSALFLAFYGWHAYKASVGWEEVYVCSVELIKVILEIYFEFTSPATVYLSTGNHAYCLRYFEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWGMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 144 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEAYHTVPKGRCRQVVTGMAWLFFVSWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 145 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHIIMYGDIRRPVSSQFLGRKVDVLAFVTEEDKV

SEQ ID NO: 146 - protein, 358 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGALWEQETARGFQWFAVFLSALFLAFYGWHAYKASVGWEEVYVCSVELIKVILEIYFEFTEPAVIYSSGGNKTVWLRYAEWLLTCPVILIHLSNITGLANDYNKRTMGLLVSDLGTICMGVTAALATGWVKWLFYCIGLVYGGYMYFQAAKCYVESYYIMPKGRCRQVVTGMAWLFFVSWGMFPILFILGPEGFGVLSVAGSTIGHTIADLLSKNIWGLLGHYLRVLIHEHIIMYGDIRRPVSSQFLGRKVDVLAFVTEEDKV

SEQ ID NO: 147 - protein, 358 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTNAEKLAANILQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEAYHTVPKGRCRQVVTGMAWLFFVSWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 148 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGTPGEKIGAQVCQWITFALSALCLMFYGYQTWKSTCGWEEIYVATIEMIKFIIEYFHEFDSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSPYANSIGHSICDIIAKEFWTFLAHHLRIKIHEHILIHGDIRKTTKLNIGGTEIEVETLVEDEAEAGAV

SEQ ID NO: 149 - protein, 358 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 150 - protein, 361 aa, Artificial Sequence
  Synthetic Polypeptide
MSRRPWLLALALAVALAAGSAGAAHIVMVDAYKPTKSTGSDATVPVATQDGPDYVFHRAHERMLFQTSYTLENNGSVICIPNNGQCFCLAWLKSNGALWEQETARGFQWFTFALSALCLMFYGYQTWKSTCGWEEIYVATIEMIKFIIEYFHEFDSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDEAEAGAV

SEQ ID NO: 151 - protein, 356 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTNAEKLAANILQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHIIMYGDIRRPVSSQFLGRKVDVLAFVTEEDKV

SEQ ID NO: 152 - protein, 359 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTNAEKLAANILQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKLNIGGTEIEVETLVEDEAEAGAV

SEQ ID NO: 153 - protein, 359 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLTGLANDYNKRTMGLIVSCVGMIVFGMAAGLATDWLKWLLYIVSCIYGGYMYFQAAKCYVEAYHTVPKGHCRMVVKLMAYAYFASWGSYPILFILGPEGFGVLSPYANSIGHSICDIIAKEFWTFLAHHLRIKIHEHILIHGDIRKTTKLNIGGTEIEVETLVEDEAEAGAV

SEQ ID NO: 154 - protein, 359 aa, Artificial Sequence
  Synthetic Polypeptide
MSRLVAASWLLALLLCGITSTTTASAHIVMVDAYKPTKSAPAASSTDGTAAAAVSHYAMNGFDELAKGAVVPEDHFVCGPADKCYCSAWLHSRGALWEQETARGFQWFAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKLNIGGTEIEVETLVEDEAEAGAV

SEQ ID NO: 155 - protein, 347 aa, Artificial Sequence
  Synthetic Polypeptide
MSRRPWLLALALAVALAAGSAGATGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 156 - protein, 344 aa, Artificial Sequence
  Synthetic Polypeptide
MSRLVAASWLLALLLCGITSTTTASAPAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 157 - protein, 347 aa, Artificial Sequence
  Synthetic Polypeptide
MSRRPWLLALALAVALAAGSAGATGSDATVPVATQDGPDYVFHRAHERMLFQTSYTLENNGSVICIPNNGQCFCLAWLKSNGTPGEKIGAQVCQWITFALSALCLMFYGYQTWKSTCGWEEIYVATIEMIKFIIEYFHEFDSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDEAEAGAV

SEQ ID NO: 158 - protein, 342 aa, Artificial Sequence
  Synthetic Polypeptide
MSRLVAASWLLALLLCGITSTTTASAPAASSTDGTAAAAVSHYAMNGFDELAKGAVVPEDHFVCGPADKCYCSAWLHSRGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 159 - protein, 347 aa, Artificial Sequence
  Synthetic Polypeptide
MSRRPWLLALALAVALAAGSAGATGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDEAEAGAV

SEQ ID NO: 160 - protein, 347 aa, Artificial Sequence
  Synthetic Polypeptide
MSRRPWLLALALAVALAAGSAGATGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSGGNKTVWLRYAEWLLTCPVILIHLSNLTGLANDYNKRTMGLLVSDLGTICMGVTAALATGWVKWLFYCIGLVYGGYMYFQAAKCYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 161 - protein, 347 aa, Artificial Sequence
  Synthetic Polypeptide
MSRRPWLLALALAVALAAGSAGATGSDATVPVATQDGPDYVFHRAHERMLFQTSYTLENNGSVICIPNNGQCFCLAWLKSNGTPGEKIGAQVCQWITFALSALCLMFYGYQTWKSTCGWEEIYVATIEMIKFIIEYFHEFDEPAVIYSSNGNKTVWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDEAEAGAV

SEQ ID NO: 162 - protein, 347 aa, Artificial Sequence
  Synthetic Polypeptide
MSRRPWLLALALAVALAAGSAGATGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSGGNKTVWLRYAEWLLTCPVILIHLSNLTGLANDYNKRTMALLVSDIGTIVWGTTAALATGWVKWLFYCIGLVYGTQTFYNAGIIYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 163 - protein, 347 aa, Artificial Sequence
  Synthetic Polypeptide
MSRRPWLLALALAVALAAGSAGATGSDATVPVATQDGPDYVFHRAHERMLFQTSYTLENNGSVICIPNNGQCFCLAWLKSNGALWEQETARGFQWFAFFLSALFLAFYGYQTWKSTCGWEEIYVATIEMIKFIIEYFHEFDEPAVIYSSGGNKTVWLRYAEWLLTCPVILIHLSNLTGLANDYNKRTMALLVSDIGTIVWGTTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHYLRVLIHEHILIHGDIRKTTKLNIGGTEIEVETLVEDEAEAGAV

SEQ ID NO: 164 - protein, 347 aa, Artificial Sequence
  Synthetic Polypeptide
MSRRPWLLALALAVALAAGSAGATGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSGGNKTVWLRYAEWLLTCPVILIHLSNLTGLANDYNKRTMGLLVSDIGTIVWGTTAALATGWVKWLFYCIGLVYGGYMYFQAAKCYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 165 - protein, 343 aa, Artificial Sequence
  Synthetic Polypeptide
MSRLVAASWLLALLLCGITSTTTASSAPAASSTDGTAAAAVSHYAMNGFDELAKGAVVPEDHFVCGPADKCYCSAWLHSRGALWEQETARGFQWFAVFLSALFLAFYGWHAYKASVGWEEVYVCSVELIKVILEIYFEFTSPATVYLSGGNHAYWLRYAEWLLTCPVILIHLSNITGLANDYNKRTMALLVSDLGTICMGVTAALATGWVKWLFYCIGLVYGTQTFYNAGIIYVESYYIMPAGGCKKLVLAMTAVYYSSWLMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 166 - protein, 347 aa, Artificial Sequence
  Synthetic Polypeptide
MSRRPWLLALALAVALAAGSAGATGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSGGNKTVWLRYAEWLLTCPVILIHLSNLTGLKNDYSKRTMALLVSDIGTIVWGTTAALATGWVKWLFYCIGLVYGTQTFYNAGIIYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 167 - protein, 347 aa, Artificial Sequence
  Synthetic Polypeptide
MSRRPWLLALALAVALAAGSAGATGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDEAEAGAV

SEQ ID NO: 168 - protein, 347 aa, Artificial Sequence
  Synthetic Polypeptide
MSRRPWLLALALAVALAAGSAGATGSDATVPVATQDGPDYVFHRAHERMLFQTSYTLENNGSVICIPNNGQCFCLAWLKSNGALWEQETARGFQWFAFFLSALFLAFYGYQTWKSTCGWEEIYVATIEMIKFIIEYFHEFDEPAVIYSSGGNKTVWLRYAEWLLTCPVILIHLSNLTGLANDYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHYLRVLIHEHILIHGDIRKTTKLNIGGTEIEVETLVEDEAEAGAV

SEQ ID NO: 169 - protein, 342 aa, Artificial Sequence
  Synthetic Polypeptide
MSRLVAASWLLALLLCGITSTTTASAPAASSTDGTAAAAVSHYAMNGFDELAKGAVVPEDHFVCGPADKCYCSAWLHSRGALWEQETARGFQWFAVFLSALFLAFYGWHAYKASVGWEEVYVCSVELIKVILEIYFEFTSPATVYLSGGNHAYWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWLMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 170 - protein, 347 aa, Artificial Sequence
  Synthetic Polypeptide
MSRRPWLLALALAVALAAGSAGATGSDATVPVATQDGPDYVFHRAHERMLFQTSYTLENNGSVICIPNNGQCFCLAWLKSNGTPGEKIGAQVCQWITFALSALCLMFYGYQTWKSTCGWEEIYVATIEMIKFIIEYFHEFDSPAMLFLYGGNITPWLRYAEWLLTCPVILIHLSNITGLSEAYNKRTMALLVSCVGMIVFGMAAGLATDWLKWLLYIVSCIYGGYMYFQAAKCYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDEAEAGAV

SEQ ID NO: 171 - protein, 342 aa, Artificial Sequence
  Synthetic Polypeptide
MSRLVAASWLLALLLCGITSTTTASAPAASSTDGTAAAAVSHYAMNGFDELAKGAVVPEDHFVCGPADKCYCSAWLHSRGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWGMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 172 - protein, 344 aa, Artificial Sequence
  Synthetic Polypeptide
MSRRPWLLALALAVALAAGSAGATGSDATVPVATQDGPDYVFHRAHERMLFQTSYTLENNGSVICIPNNGQCFCLAWLKSNGALWEQETARGFQWFAVFLSALFLAFYGWHAYKASVGWEEVYVCSVELIKVILEIYFEFTEPAVIYSSGGNKTVWLRYAEWLLTCPVILIHLSNITGLANDYNKRTMGLLVSDLGTICMGVTAALATGWVKWLFYCIGLVYGGYMYFQAAKCYVESYYIMPKGRCRQVVTGMAWLFFVSWGMFPILFILGPEGFGVLSVAGSTIGHTIADLLSKNIWGLLGHYLRVLIHEHIIMYGDIRRPVSSQFLGRKVDVLAFVTEEDKV

SEQ ID NO: 173 - protein, 347 aa, Artificial Sequence
  Synthetic Polypeptide
MSRRPWLLALALAVALAAGSAGATGSDATVPVATQDGPDYVFHRAHERMLFQTSYTLENNGSVICIPNNGQCFCLAWLKSNGTPGEKIGAQVCQWITFALSALCLMFYGYQTWKSTCGWEEIYVATIEMIKFIIEYFHEFDSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSPYANSIGHSICDIIAKEFWTFLAHHLRIKIHEHILIHGDIRKTTKLNIGGTEIEVETLVEDEAEAGAV

SEQ ID NO: 174 - protein, 344 aa, Artificial Sequence
  Synthetic Polypeptide
MSRRPWLLALALAVALAAGSAGATGSDATVPVATQDGPDYVFHRAHERMLFQTSYTLENNGSVICIPNNGQCFCLAWLKSNGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 175 - protein, 347 aa, Artificial Sequence
  Synthetic Polypeptide
MSRRPWLLALALAVALAAGSAGATGSDATVPVATQDGPDYVFHRAHERMLFQTSYTLENNGSVICIPNNGQCFCLAWLKSNGALWEQETARGFQWFTFALSALCLMFYGYQTWKSTCGWEEIYVATIEMIKFIIEYFHEFDSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDEAEAGAV

SEQ ID NO: 176 - protein, 324 aa, Artificial Sequence
  Synthetic Polypeptide
TGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 177 - protein, 319 aa, Artificial Sequence
  Synthetic Polypeptide
APAASSTDGTAAAAVSHYAMNGFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 178 - protein, 324 aa, Artificial Sequence
  Synthetic Polypeptide
TGSDATVPVATQDGPDYVFHRAHERMLFQTSYTLENNGSVICIPNNGQCFCLAWLKSNGTPGEKIGAQVCQWITFALSALCLMFYGYQTWKSTCGWEEIYVATIEMIKFIIEYFHEFDSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDEAEAGAV

SEQ ID NO: 179 - protein, 317 aa, Artificial Sequence
  Synthetic Polypeptide
APAASSTDGTAAAAVSHYAMNGFDELAKGAVVPEDHFVCGPADKCYCSAWLHSRGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 180 - protein, 324 aa, Artificial Sequence
  Synthetic Polypeptide
TGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDEAEAGAV

SEQ ID NO: 181 - protein, 324 aa, Artificial Sequence
  Synthetic Polypeptide
TGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSGGNKTVWLRYAEWLLTCPVILIHLSNLTGLANDYNKRTMGLLVSDLGTICMGVTAALATGWVKWLFYCIGLVYGGYMYFQAAKCYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 182 - protein, 324 aa, Artificial Sequence
  Synthetic Polypeptide
TGSDATVPVATQDGPDYVFHRAHERMLFQTSYTLENNGSVICIPNNGQCFCLAWLKSNGTPGEKIGAQVCQWITFALSALCLMFYGYQTWKSTCGWEEIYVATIEMIKFIIEYFHEFDEPAVIYSSNGNKTVWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDEAEAGAV

SEQ ID NO: 183 - protein, 324 aa, Artificial Sequence
  Synthetic Polypeptide
TGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSGGNKTVWLRYAEWLLTCPVILIHLSNLTGLANDYNKRTMALLVSDIGTIVWGTTAALATGWVKWLFYCIGLVYGTQTFYNAGIIYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 184 - protein, 324 aa, Artificial Sequence
  Synthetic Polypeptide
TGSDATVPVATQDGPDYVFHRAHERMLFQTSYTLENNGSVICIPNNGQCFCLAWLKSNGALWEQETARGFQWFAFFLSALFLAFYGYQTWKSTCGWEEIYVATIEMIKFIIEYFHEFDEPAVIYSSGGNKTVWLRYAEWLLTCPVILIHLSNLTGLANDYNKRTMALLVSDIGTIVWGTTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHYLRVLIHEHILIHGDIRKTTKLNIGGTEIEVETLVEDEAEAGAV

SEQ ID NO: 185 - protein, 324 aa, Artificial Sequence
  Synthetic Polypeptide
TGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSGGNKTVWLRYAEWLLTCPVILIHLSNLTGLANDYNKRTMGLLVSDIGTIVWGTTAALATGWVKWLFYCIGLVYGGYMYFQAAKCYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 186 - protein, 317 aa, Artificial Sequence
  Synthetic Polypeptide
APAASSTDGTAAAAVSHYAMNGFDELAKGAVVPEDHFVCGPADKCYCSAWLHSRGALWEQETARGFQWFAVFLSALFLAFYGWHAYKASVGWEEVYVCSVELIKVILEIYFEFTSPATVYLSGGNHAYWLRYAEWLLTCPVILIHLSNITGLANDYNKRTMALLVSDLGTICMGVTAALATGWVKWLFYCIGLVYGTQTFYNAGIIYVESYYIMPAGGCKKLVLAMTAVYYSSWLMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 187 - protein, 324 aa, Artificial Sequence
  Synthetic Polypeptide
TGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSGGNKTVWLRYAEWLLTCPVILIHLSNLTGLKNDYSKRTMALLVSDIGTIVWGTTAALATGWVKWLFYCIGLVYGTQTFYNAGIIYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 188 - protein, 324 aa, Artificial Sequence
  Synthetic Polypeptide
TGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDEAEAGAV

SEQ ID NO: 189 - protein, 324 aa, Artificial Sequence
  Synthetic Polypeptide
TGSDATVPVATQDGPDYVFHRAHERMLFQTSYTLENNGSVICIPNNGQCFCLAWLKSNGALWEQETARGFQWFAFFLSALFLAFYGYQTWKSTCGWEEIYVATIEMIKFIIEYFHEFDEPAVIYSSGGNKTVWLRYAEWLLTCPVILIHLSNLTGLANDYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHYLRVLIHEHILIHGDIRKTTKLNIGGTEIEVETLVEDEAEAGAV

SEQ ID NO: 190 - protein, 317 aa, Artificial Sequence
  Synthetic Polypeptide
APAASSTDGTAAAAVSHYAMNGFDELAKGAVVPEDHFVCGPADKCYCSAWLHSRGALWEQETARGFQWFAVFLSALFLAFYGWHAYKASVGWEEVYVCSVELIKVILEIYFEFTSPATVYLSGGNHAYWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWLMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 191 - protein, 324 aa, Artificial Sequence
  Synthetic Polypeptide
TGSDATVPVATQDGPDYVFHRAHERMLFQTSYTLENNGSVICIPNNGQCFCLAWLKSNGTPGEKIGAQVCQWITFALSALCLMFYGYQTWKSTCGWEEIYVATIEMIKFIIEYFHEFDSPAMLFLYGGNITPWLRYAEWLLTCPVILIHLSNITGLSEAYNKRTMALLVSCVGMIVFGMAAGLATDWLKWLLYIVSCIYGGYMYFQAAKCYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDEAEAGAV

SEQ ID NO: 192 - protein, 317 aa, Artificial Sequence
  Synthetic Polypeptide
APAASSTDGTAAAAVSHYAMNGFDELAKGAVVPEDHFVCGPADKCYCSAWLHSRGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWGMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 193 - protein, 321 aa, Artificial Sequence
  Synthetic Polypeptide
TGSDATVPVATQDGPDYVFHRAHERMLFQTSYTLENNGSVICIPNNGQCFCLAWLKSNGALWEQETARGFQWFAVFLSALFLAFYGWHAYKASVGWEEVYVCSVELIKVILEIYFEFTEPAVIYSSGGNKTVWLRYAEWLLTCPVILIHLSNITGLANDYNKRTMGLLVSDLGTICMGVTAALATGWVKWLFYCIGLVYGGYMYFQAAKCYVESYYIMPKGRCRQVVTGMAWLFFVSWGMFPILFILGPEGFGVLSVAGSTIGHTIADLLSKNIWGLLGHYLRVLIHEHIIMYGDIRRPVSSQFLGRKVDVLAFVTEEDKV

SEQ ID NO: 194 - protein, 324 aa, Artificial Sequence
  Synthetic Polypeptide
TGSDATVPVATQDGPDYVFHRAHERMLFQTSYTLENNGSVICIPNNGQCFCLAWLKSNGTPGEKIGAQVCQWITFALSALCLMFYGYQTWKSTCGWEEIYVATIEMIKFIIEYFHEFDSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSPYANSIGHSICDIIAKEFWTFLAHHLRIKIHEHILIHGDIRKTTKLNIGGTEIEVETLVEDEAEAGAV

SEQ ID NO: 195 - protein, 321 aa, Artificial Sequence
  Synthetic Polypeptide
TGSDATVPVATQDGPDYVFHRAHERMLFQTSYTLENNGSVICIPNNGQCFCLAWLKSNGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHIIMYGDIRRPVSSQFLGRKVDVLAFVTEEDKV

SEQ ID NO: 196 - protein, 324 aa, Artificial Sequence
  Synthetic Polypeptide
TGSDATVPVATQDGPDYVFHRAHERMLFQTSYTLENNGSVICIPNNGQCFCLAWLKSNGALWEQETARGFQWFTFALSALCLMFYGYQTWKSTCGWEEIYVATIEMIKFIIEYFHEFDSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDEAEAGAV

SEQ ID NO: 197 - protein, 23 aa, Artificial Sequence
  Synthetic Polypeptide
MSRRPWLLALALAVALAAGSAGA

SEQ ID NO: 198 - protein, 25 aa, Artificial Sequence
  Synthetic Polypeptide
MSRLVAASWLLALLLCGITSTTTAS

SEQ ID NO: 199 - protein, 20 aa, Artificial Sequence
  Synthetic Polypeptide
KSRITSEGEYIPLDQIDINV

SEQ ID NO: 200 - protein, 291 aa, Artificial Sequence
  Synthetic Polypeptide
MTTISEVCGVWALDNPECIEVSGTNDNVKMAQLCFCMVCVCQILFMASQYPKVGWEAIYLPSCECFLYGLASSGNGFIQLYDGRLIPWARYAAWICTCPSILLQINTIHKCKISHFNLNTFIVQADLIMNIMGVTGALTTNIAFKWIYFAIGCILFIFIVLVVYDIMTSAAKEWKAKGDSKGNLVSTRLILLRWIFIVSWCVYPLLWILSPQATCAVSEDVISVAHFICDAFAKNMFGFIMWRTLWRDLDGHWDISRHYPQSSYAKDGKEEEQMTAMSQTDDTEKPHSSQG

SEQ ID NO: 201 - protein, 305 aa, Artificial Sequence
  Synthetic Polypeptide
MTMLEHLEGTMDGWYAENDLGQGAIIAHWVTFFFHMITTFYLGYVSFHSKGPGGKQPYFAGYHEENNIGIFVNLFAAISYFGKVVSDTHGHNYQNVGPFIIGLGNYRYADYMLTCPLLVMDLLFQLRAPYKITCAMLIFAVLMIGAVTNFYPGDDMKGPAVAWFCFGCFWYLIAYIFMAHIVSKQYGRLDYLAHGTKAEGALFSLKLAIITFFAIWVAFPLVWLLSVGTGVLSNEAAEICHCICDVVAKSVYGFALANFREQYDRELYGLLNSIGLDGEDVVQQLEKEMQTNHHKKKSINSPAVG

SEQ ID NO: 202 - protein, 331 aa, Artificial Sequence
  Synthetic Polypeptide
MSPPTSPTPDTGHDTPDTGHDTGGHGAVEICFAPCEEDCVTIRYFVENDFEGCIPGHFDQYSSHGSLHDIVKAALYICMVISILQILFYGFQWWRKTCGWEVWFVACIETSIYIIAITSEADSPFTLYLTNGQISPQLRYMEWLMTCPVILIALSNITGMAEEYNKRTMTLLTSDVCCIVLGMMSAASKPRLKGILYAVGWAFGAWTYWTALQVYRDAHKAVPKPLAWYVRAMGYVFFTSWLTFPGWFLLGPEGLEVVTGTVSTLMHACSDLISKNLWGFMDWHLRVLVARHHRKLFKAEEEHALKKGQTLEPGMPRSTSFVRGLGDDVEI

SEQ ID NO: 203 - protein, 316 aa, Artificial Sequence
  Synthetic Polypeptide
MGGAPAPDAHSAPPGNDSAGGSEYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEEYNKRTMALLVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEEDKV

SEQ ID NO: 204 - protein, 292 aa, Artificial Sequence
  Synthetic Polypeptide
MGWKINPLYSDEVAILEICKENEMVFGPLWEQKLARALQWFTVILSAIFLAYYVYSTLRATCGWEELYVCTVEFTKVVVEVYLEYVPPFMIYQMNGQHTPWLRYMEWLLTCPVILIHLSNITGLNDEYSGRTMSLLTSDLGGIAFAVLSALAVGWQKGLYFGIGCIYGASTFYHAACIYIESYHTMPAGKCKRLVVAMCAVFFTSWFMFPALFLAGPECFDGLTWSGSTIAHTVADLLSKNIWGLIGHFLRVGIHEHILVHGDVRRPIEVTIFGKETSLNCFVENDDEEDDV

SEQ ID NO: 205 - protein, 293 aa, Artificial Sequence
  Synthetic Polypeptide
MFAINPEYMNETVLLDECTPIYLDIGPLWEQVVARVTQWFGVILSLVFLIYYIWNTYKATCGWEELYVCTVEFCKIIIELYFEYTPPAMIFQTNGQVTPWLRYAEWLLTCPVILIHLSNITGLNDDYSGRTMSLITSDLGGICMAVTAALSKGWLKALFFVIGCGYGASTFYNAACIYIESYYTMPQGICRRLVLWMAGVFFTSWFMFPGLFLAGPEGTQALSWAGTTIGHTVADLLSKNAWGMIGHFLRVEIHKHIIIHGDVRRPVTVKALGRQVSVNCFVDKEEEEEDERI

SEQ ID NO: 206 - protein, 349 aa, Artificial Sequence
  Synthetic Polypeptide
MAAGLEGLVSSASRGLHASIPENPYHSDGHHLPCGLTPFGCMDDFWCNPEYGMSYAGYTYCFSELAFGKLVMVPEADAGWLHSHGTQAEFVAATACQYTALSLALLLLSFYAYSAWKATCGWEEGYVCCVEVLFVTLEISNEFNSPATLYLSTGNYCYFLRYGEWLLSCPVILIHLSNLSGLKNDYSMRTMRLLVSCIGMLITGMAGGLGVGWVKWTLYFVSCAYSAQTYLQAAKCYVEVYATVPKGYCRTVVKLMAYAFFTAWGAYPILWAIGPEGLKYISGYSNTIAHTFCDILAKEIWTFLGHHLRIKIHEHILIHGDIRKKVQVRVAGELMNVEELMEEEGEDTV

SEQ ID NO: 207 - protein, 350 aa, Artificial Sequence
  Synthetic Polypeptide
MAELISSATRSLFAAGGINPWPNPYHHEDMGCGGMTPTGECFSTEWWCDPSYGLSDAGYGYCFVEATGGYLVVGVEKKQAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIKLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEEDEDTV

SEQ ID NO: 208 - protein, 325 aa, Artificial Sequence
  Synthetic Polypeptide
METAATMTHAFISAVPSAEATIRGLLSAAAVVTPAADAHGETSNATTAGADHGCFPHINHGTELQHKIAVGLQWFTVIVAIVQLIFYGWHSFKATTGWEEVYVCVIELVKCFIELFHEVDSPATVYQTNGGAVIWLRYSMWLLTCPVILIHLSNLTGLHEEYSKRTMTILVTDIGNIVWGITAAFTKGPLKILFFMIGLFYGVTCFFQIAKVYIESYHTLPKGVCRKICKIMAYVFFCSWLMFPVMFIAGHEGLGLITPYTSGIGHLILDLISKNTWGFLGHHLRVKIHEHILIHGDIRKTTTINVAGENMEIETFVDEEEEGGV

SEQ ID NO: 209 - protein, 307 aa, Artificial Sequence
  Synthetic Polypeptide
MSVNLSLWEHGEDAGYGHWYQGTPNGTLVCSHEDNIAWLKNKGTDEEMLGANICMWMAFAACLLCLSFYAYSTWRATCGWEEVYVCLVEMVKVMIEVFHENDSPATLYLSTGNFIMWIRYGEWLLSCPVILIHLSNITGLQDQYSKRTMQLLVSDLGTITMGVTAALCGNYVKWIFFILGLCYGVNTYFHAAKVYIESYHIVPKGVCRVCVRVMAWCFFGAWTCYPLLFVFGPEGLGVLSYNASAIGHTIIDIFSKQVWGFVGHYLRIKIHEHIVIHGNLVKPTKVKVAGMEIDAEEMVEKDEEGAI

SEQ ID NO: 210 - protein, 327 aa, Artificial Sequence
  Synthetic Polypeptide
MEAYAYPELLGSAGRSLFAATVPENISESTWVDAGYQHFWTQRQNETVVCEHYTHASWLISHGTKAEKTAMIACQWFAFGSAVLILLLYAWHTWKATSGWEEVYVCCVELVKVLFEIYHEIHHPCTLYLVTGNFILWLRYGEWLLTCPVILIHLSNITGLKNDYNKRTMQLLVSDIGCVVWGVTAALCYDYKKWIFFCLGLVYGCNTYFHAAKVYIEGYHTVPKGECRIIVKVMAGVFYCSWTLFPLLFLLGPEGTGAFSAYGSTIAHTVADVLSKQLWGLLGHHLRVKIHEHIIIHGNLTVSKKVKVAGVEVETQEMVDSTEEDAV

SEQ ID NO: 211 - protein, 349 aa, Artificial Sequence
  Synthetic Polypeptide
MEPVLGLASTAVRELTAGGSGNPYESYKPPEDPCALTPFGCLTNFWCDPQFGLADAKYDYCYVKAAYGELAIVETSRLPWLYSHGSDAEHQGALAMQWMAFALCIICLVFYAYHSWKATTGWEEVYVCVVELVKVLLEIYKEFESPASIYLPTANAALWLRYGEWLLTCPVILIHLSNITGLKDDYNKRTMQLLVSDIGCVVWGITAAFSVGWLKWVFFVLGLLYGSNTYFHAAKVYIESYHTVPKGHCRLIVRLMAYCFYVAWTMYPILFILGPEGLGHMSAYMSTALHGVADMLSKQIWGLLGHHLRVKIFEHILIHGDIRKTTTMQVGGQMVQVEEMVDEEDEDTI

SEQ ID NO: 212 - protein, 346 aa, Artificial Sequence
  Synthetic Polypeptide
MSRLVAASWLLALLLCGITSTTTASSAPAASSTDGTAAAAVSHYAMNGFDELAKGAVVPEDHFVCGPADKCYCSAWLHSHGSKEEKTAFTVMQWIVFAVCIISLLFYAYQTWRATCGWEEVYVTIIELVHVCFGLWHEVDSPCTLYLSTGNMVLWLRYAEWLLTCPVILIHLSNLTGMKNDYNKRTMALLVSDVGCIVWGTTAALSTDFVKIIFFFLGLLYGFYTFYAAAKIYIEAYHTVPKGICRQLVRLQAYDFFFTWSMFPILFMVGPEGFGKITAYSSGIAHEVCDLLSKNLWGLMGHFIRVKIHEHILVHGNITKKTKVNVAGDMVELDTYVDQDEEHDEG

SEQ ID NO: 213 - protein, 323 aa, Artificial Sequence
  Synthetic Polypeptide
MGTPDPLLSSIPGTDIGLGDWTEYSNYYFLNATNSTHKWVAGPEDDCFCKAWTFNRGSDEESVAAFAIAWVVFSLSVLQLLYYAYAQWRSTCGWEEVYVGIIELTHICIAIFREFDSPAMLYLSTGNFVVWARYASWLLSCPVILIHLSNLTGMKGNYSKRTMALLVSDIGTIVWGSTSAMSPHNHVKIIFFFLGLVFGLFTFYAAAKVYLEAYHTVPKGKCRNIVRFMAWTYYVTWALFPILFILGPEGFGHITYYGSSIGHYVLEIFSKNLWSGTGHYLRLKIHEHIILHGNLTKKTKINIAGEPLEVEEYVEADDTDEGV

SEQ ID NO: 214 - protein, 310 aa, Artificial Sequence
  Synthetic Polypeptide
MADFVWQGAGNGGPSAMVSHYPNGSVLLESSGSCYCEDWYTSRGNHVEHSLSNACDWFAFAISVIFLVYYAWAAFNSSVGWEEIYVCTVELIKVSIDQFLSSNSPCTLYLSTGNRVLWIRYGEWLLTCPVILIHLSNVTGLKDNYSKRTMALLVSDIGTIVFGVTSAMCTGYPKVIFFILGCCYGANTFFNAAKVYLEAHHTLPKGSCRTLIRLMAYTYYASWGMFPILFVLGPESFGHMNMYQSNIAHTVIDLMSKNIWGMLGHFLRHKIREHILIHGDLRTTTTVNVAGEEMQVETMVAAEDADETTV

SEQ ID NO: 215 - protein, 288 aa, Artificial Sequence
  Synthetic Polypeptide
MLGNGSAIVPIDQCFCLAWTDSLGSDTEQLVANILQWFAFGFSILILMFYAYQTWRATCGWEEVYVCCVELTKVIIEFFHEFDDPSMLYLANGHRVQWLRYAEWLLTCPVILIHLSNLTGLKDDYSKRTMRLLVSDVGTIVWGATSAMSTGYVKVIFFVLGCIYGANTFFHAAKVYIESYHVVPKGRPRTVVRIMAWLFFLSWGMFPVLFVVGPEGFDAISVYGSTIGHTIIDLMSKNCWGLLGHYLRVLIHQHIIIYGDIRKKTKINVAGEEMEVETMVDQEDEETV

SEQ ID NO: 216 - protein, 300 aa, Artificial Sequence
  Synthetic Polypeptide
MDHPVARSLIGSSYTNLNNGSIVIPSDACFCMKWLKSKGSPVALKMANALQWAAFALSVIILIYYAYATWRTTCGWEEVYVCCVELTKVVIEFFHEFDEPGMLYLANGNRVLWLRYGEWLLTCPVILIHLSNLTGLKDDYNKRTMRLLVSDVGTIVWGATSAMCTGWTKILFFLISLSYGMYTYFHAAKVYIEAFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEEED

SEQ ID NO: 217 - protein, 300 aa, Artificial Sequence
  Synthetic Polypeptide
MDHPVARSLIGSSYTNLNNGSIVIPSDACFCMKWLKSKGSPVALKMANALQWAAFALSVIILIYYAYATWRTTCGWEEVYVCCVELTKVVIEFFHEFDEPGMLYLANGNRVLWLRYGEWLLTCPVILIHLSNLTGLKDDYSKRTMGLLVSDVGCIVWGATSAMCTGWTKILFFLISLSYGMYTYFHAAKVYIEAFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEEED

SEQ ID NO: 218 - protein, 300 aa, Artificial Sequence
  Synthetic Polypeptide
MDHPVARSLIGSSYTNLNNGSIVIPSDACFCMKWLKSKGSPVALKMANALQWAAFALSVIILIYYAYATWRTTCGWEEVYVCCVELTKVVIEFFHEFDEPGMLYLANGNRVLWLRYGEWLLTCPVLLIHLSNLTGLKDDYSKRTMGLLVSDVGCIVWGATSAMCTGWTKILFFLISLSYGMYTYFHAAKVYIEAFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEEED

SEQ ID NO: 219 - protein, 300 aa, Artificial Sequence
  Synthetic Polypeptide
MDHPVARSLIGSSYTNLNNGSIVIPSDACFCMKWLKSKGSPVALKMANALQWAAFALSVIILIYYAYATWRTTCGWEEVYVCCVELTKVVIEFFHEFDEPGMLYLANGNRVLWLRYGEWLLTCPVILIHLSNLTGLKDDYNKRTMRLLVSDVGTIVWGATAAMSTGYIKVIFFLLGCMYGANTFFHAAKVYIESYHTVPKGLCRQLVRAMAWLFFVSWGMFPVLFLLGPEGFGHLSVYGSTIGHSILDLIAKNMWGVLGNYLRVKIHEHILLYGDIRKKQKITIAGQEMEVETLVAEEED

SEQ ID NO: 220 - protein, 300 aa, Artificial Sequence
  Synthetic Polypeptide
MDYPVARSLIVRYPTDLGNGTVCMPRGQCYCEGWLRSRGTSIEKTIAITLQWVVFALSVIILIYYAYATWRTTCGWEEVYVCCVELTKVVIEFFHEFDEPGMLYLANGNRVLWLRYGEWLLTCPVILIHLSNLTGLKDDYNKRTMRLLVSDVGTIVWGATAAMSTGYIKVIFFLLGCMYGANTFFHAAKVYIEAFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEEED

SEQ ID NO: 221 - protein, 300 aa, Artificial Sequence
  Synthetic Polypeptide
MDYPVARSLIVRYPTDLGNGTVCMPRGQCYCEGWLRSRGTSIEKTIAITLQWVVFALSVACLGWYAYQAWRATCGWEEVYVALIEMMKSIIEAFHEFDSPATLWLSSGNGVVWMRYGEWLLTCPVLLIHLSNLTGLKDDYSKRTMGLLVSDVGCIVWGATSAMCTGWTKILFFLISLSYGMYTYFHAAKVYIEAFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEEED

SEQ ID NO: 222 - protein, 300 aa, Artificial Sequence
  Synthetic Polypeptide
MDYPVARSLIVRYPTDLGNGTVCMPRGQCYCEGWLRSRGTSIEKTIAITLQWVVFALSVACLGWYAYQAWRATCGWEEVYVALIEMMKSIIEAFHEFDSPAMLYLANGNRVLWLRYGEWLLTCPVILIHLSNLTGLKDDYNKRTMRLLVSDVGTIVWGATAAMSTGYIKILFFLISLSYGMYTYFHAAKVYIEAFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEEED

SEQ ID NO: 223 - protein, 300 aa, Artificial Sequence
  Synthetic Polypeptide
MDYPVARSLIVRYPTDLGNGTVCMPRGQCYCEGWLRSRGTSIEKTIAITLQWVVFALSVACLGWYAYQAWRATCGWEEVYVALIEMMKSIIEAFHEFDSPATLWLSSGNGVVWMRYGEWLLTCPVLLIHLSNLTGLKDDYSKRTMGLLVSDVGCIVWGATSAMCTGYIKVIFFLLGCMYGANTFFHAAKVYIESYHTVPKGLCRQLVRAMAWLFFVSWGMFPVLFLLGPEGFGHLSVYGSAIGHSILDLIAKNMWGVLGNYLRVKIHEHILLYGDIRKKQKITIAGQEMEVETLVAEEED

SEQ ID NO: 224 - protein, 300 aa, Artificial Sequence
  Synthetic Polypeptide
MDYPVARSLIVRYPTDLGNGTVCMPRGQCYCEGWLRSRGTSIEKTIAITLQWVVFALSVACLGWYAYQAWRATCGWEEVYVALIEMMKSIIEAFHEFDSPATLWLSSGNGVVWMRYGEWLLTCPVILIHLSNLTGLKDDYNKRTMRLLVSDVGTIVWGATAAMSTGYIKVIFFLLGCMYGANTFFHAAKVYIESFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEEED

SEQ ID NO: 225 - protein, 308 aa, Artificial Sequence
  Synthetic Polypeptide
MDYPVARSLIVRYPTDLGNGTVCMPRGQCYCEGWLRSRGTSIEKTIAITLQWVVFALSVACLGWYAYQAWRATCGWEEVYVALIEMMKSIIEAFHEFDSPATLWLSSGNGVVWMRYGEWLLTCPVLLIHLSNLTGLKDDYSKRTMGLLVSDVGCIVWGATSAMCTGWTKILFFLISLSYGMYTYFHAAKVYIEAFHTVPKGICRELVRAMAWLFFVSWGMFPVLFLLGPEGFGHLSVYGSTIGHTIIDLLSKNCWGLLGHFLRLKIHEHILLYGDIRKVQKIRVAGEELEVETLMTEEAPDTVKKSTA

SEQ ID NO: 226 - protein, 308 aa, Artificial Sequence
  Synthetic Polypeptide
MDYPVARSLIVRYPTDLGNGTVCMPRGQCYCEGWLRSRGTSIEKTIAITLQWVVFALSVACLGWYAYQAWRATCGWEEVYVALIEMMKSIIEAFHEFDSPATLWLSSGNGVVWMRYGEWLLTCPVLLIHLSNLTGLKDDYNKRTMRLLVSDVGTIVWGATAAMSTGYIKVIFFLLGCMYGANTFFHAAKVYIESYHTVPKGLCRQLVRAMAWLFFVSWGMFPVLFLLGPEGFGHLSVYGSTIGHTIIDLLSKNCWGLLGHFLRLKIHEHILLYGDIRKVQKIRVAGEELEVETLMTEEAPDTVKKSTA

SEQ ID NO: 227 - protein, 309 aa, Artificial Sequence
  Synthetic Polypeptide
MDYGGALSAVGRELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYAEWLLTSPVILIHLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 228 - protein, 309 aa, Artificial Sequence
  Synthetic Polypeptide
MDYGGALSAVGRELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYAEWLLTCPVICIHLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 229 - protein, 309 aa, Artificial Sequence
  Synthetic Polypeptide
MDYGGALSAVGRELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYAEWLLTAPVILIHLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 230 - protein, 309 aa, Artificial Sequence
  Synthetic Polypeptide
MDYGGALSAVGRELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYAEWLLTTPVILIHLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 231 - protein, 309 aa, Artificial Sequence
  Synthetic Polypeptide
MDYGGALSAVGRELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYAEWLLTCPVILIHLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 232 - protein, 309 aa, Artificial Sequence
  Synthetic Polypeptide
MDYGGALSAVGRELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYAEWLLTCPVILIHLSNLTGLSNDYSRRTMGLLVSDIGCIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 233 - protein, 309 aa, Artificial Sequence
  Synthetic Polypeptide
MDYGGALSAVGRELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYATWLLTCPVILIHLSNLTGLSNDYSRRTMGLLVSDIGCIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 234 - protein, 309 aa, Artificial Sequence
  Synthetic Polypeptide
MDYGGALSAVGRELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYAEWLLTCPVILIRLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 235 - protein, 309 aa, Artificial Sequence
  Synthetic Polypeptide
MDYGGALSAVGRELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYATWLLTCPVILIRLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 236 - protein, 309 aa, Artificial Sequence
  Synthetic Polypeptide
MDYGGALSAVGRELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYAAWLLTCPVILIRLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 237 - protein, 309 aa, Artificial Sequence
  Synthetic Polypeptide
MDYGGALSAVGRELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYAAWLLTCPVILIHLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 238 - protein, 309 aa, Artificial Sequence
  Synthetic Polypeptide
MDYGGALSAVGRELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYATWLLTCPVILIHLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAV

SEQ ID NO: 239 - protein, 354 aa, Artificial Sequence
  Synthetic Polypeptide
MSRRPWLLALALAVALAAGSAGASTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVCAIEMVKVILEFFFEFKNPSMLYLATGHRVQWLRYAEWLLTCPVILIHLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAVNKGTGK

SEQ ID NO: 240 - protein, 344 aa, Artificial Sequence
  Synthetic Polypeptide
MSRRPWLLALALAVALAAGSAGASTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGICRDLVRYLAWLYFCSWAMFPVLFLLGPEGFGHINQFNSAIAHAILDLASKNAWSMMGHFLRVKIHEHILLYGDIRKKQKVNVAGQEMEVETMVHEEDD

SEQ ID NO: 241 - protein, 344 aa, Artificial Sequence
  Synthetic Polypeptide
MSRRPWLLALALAVALAAGSAGASTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFLLGPEGFGHINQFNSAIAHAILDLASKNAWSMMGHFLRVKIHEHILLYGDIRKKQKVNVAGQEMEVETMVHEEDD

SEQ ID NO: 242 - protein, 354 aa, Artificial Sequence
  Synthetic Polypeptide
MSRRPWLLALALAVALAAGSAGASTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFLLGPEGFGHINQFNSAIAHAILDLASKNCWGLLGHYLRVLIHEHILIHGDIRKTTKLNIGGTEIEVETLVEDEAEAGAVNKGTGK

SEQ ID NO: 243 - protein, 354 aa, Artificial Sequence
  Synthetic Polypeptide
MSRRPWLLALALAVALAAGSAGASTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGICRDLVRYLAWLYFCSWAMFPVLFLLGPEGFGVLSVYGSTVGHTIIDLMSKNCWGLLGHYLRVLIHEHILIHGDIRKTTKLNIGGTEIEVETLVEDEAEAGAVNKGTGK

SEQ ID NO: 244 - protein, 354 aa, Artificial Sequence; identical to SEQ ID NO: 243
  Synthetic Polypeptide

SEQ ID NO: 245 - protein, 354 aa, Artificial Sequence
  Synthetic Polypeptide
MSRRPWLLALALAVALAAGSAGASTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAVNKGTGK

SEQ ID NO: 246 - protein, 354 aa, Artificial Sequence; identical to SEQ ID NO: 245
  Synthetic Polypeptide

SEQ ID NO: 247 - protein, 354 aa, Artificial Sequence; identical to SEQ ID NO: 245
  Synthetic Polypeptide

SEQ ID NO: 248 - protein, 354 aa, Artificial Sequence
  Synthetic Polypeptide
MSRRPWLLALALAVALAAGSAGASTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAVNKGTGK

SEQ ID NO: 249 - protein, 354 aa, Artificial Sequence
  Synthetic Polypeptide
MSRRPWLLALALAVALAAGSAGASTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAVNKGTGK

SEQ ID NO: 250 - protein, 354 aa, Artificial Sequence
  Synthetic Polypeptide
MSRRPWLLALALAVALAAGSAGASTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAVNKGTGK

SEQ ID NO: 251 - protein, 354 aa, Artificial Sequence
  Synthetic Polypeptide
MSRRPWLLALALAVALAAGSAGASTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDEAEAGAVNKGTGK

SEQ ID NO: 252 - protein, 344 aa, Artificial Sequence
  Synthetic Polypeptide
MSRRPWLLALALAVALAAGSAGASTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGICRDLVRVMAWTFFVAWGMFPVLFLLGTEGFGHISPYGSAIGHSILDLIAKNMWGVLGNYLRVKIHEHILLYGDIRKKQKITIAGQEMEVETLVAEEED

SEQ ID NO: 253 - protein, 345 aa, Artificial Sequence
  Synthetic Polypeptide
MVSRRPWLLALALAVALAAGSAGASTGSDATVPVATQDGPDYVFHRAHERMLFQTSYTLENNGSVICIPNNGQCFCLAWLKSNGTNAEKLAANILQWVVFALSVACLGWYAYQAWRATCGWEEVYVALIEMMKSIIEAFHEFDSPATLWLSSGNGVVWMRYGEWLLTCPVLLIHLSNLTGLKDDYSKRTMGLLVSDVGCIVWGATSAMCTGWTKILFFLISLSYGMYTYFHAAKVYIEAFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEEED

SEQ ID NO: 254 - protein, 305 aa, Artificial Sequence
  Synthetic Polypeptide
MDYGGALSAVGLFQTSYTLENNGSVICIPNNGQCFCLAWLKSNGTNAEKLAANILQWVVFALSVACLGWYAYQAWRATCGWEEVYVALIEMMKSIIEAFHEFDSPATLWLSSGNGVVWMRYGSWLLTCPVILIHLSNLTGLKDDYSKRTMGLLVSDVGCIVWGATSAMCTGWTKILFFLISLSYGMYTYFHAAKVYIEAFHTVPKGLCRQLVRAMAWLFFVSWGMFPVLFLLGPEGFGHISPYGSAIGHSILDLIAKNMWGVLGNYLRVKIHEHILLYGDIRKKQKITIAGQEMEVETLVAEEED

SEQ ID NO: 255 - protein, 350 aa, Artificial Sequence
  Synthetic Polypeptide
MVSRRPWLLALALAVALAAGSAGASTGSDATVPVATQDGPDYVFHRAHERMLFQTSYTLENNGSVICIPNNGQCFCLAWLKSNGTNAEKLAANILQWVVFALSVACLGWYAYQAWRATCGWEEVYVALIEMMKSIIEAFHEFDSPATLWLSSGNGVVWMRYGEWLLTCPVILIHLSNLTGLKDDYSKRTMGLLVSDVGCIVWGATSAMCTGWTKILFFLISLSYGMYTYFHAAKVYIEAFHTVPKGLCRQLVRAMAWLFFVSWGMFPVLFLLGPEGFGHISPYGSAIGHSILDLIAKNMWGVLGNYLRVKIHEHILLYGDIRKKQKITIAGQEMEVETLVAEEEDKYESS

SEQ ID NO: 256 - protein, 350 aa, Artificial Sequence
  Synthetic Polypeptide
MVSRRPWLLALALAVALAAGSAGASTGSDATVPVATQDGPDYVFHRAHERMLFQTSYTLENNGSVICIPNNGQCFCLAWLKSNGTNAEKLAANILQWVVFALSVACLGWYAYQAWRATCGWEEVYVALIEMMKSIIEAFHEFDSPATLWLSSGNGVVWMRYGEWLLTCPVLLIHLSNLTGLKDDYSKRTMGLLVSDVGCIVWGATSAMCTGWTKILFFLISLSYGMYTYFHAAKVYIEAFHTVPKGLCRQLVRAMAWLFFVSWGMFPVLFLLGPEGFGHISPYGSAIGHSILDLIAKNMWGVLGNYLRVKIHEHILLYGDIRKKQKITIAGQEMEVETLVAEEEDKYESS

SEQ ID NO: 257 - protein, 344 aa, Artificial Sequence
  Synthetic Polypeptide
MSRRPWLLALALAVALAAGSAGASTGSDATVPVATQDGPDYVFHRAHERMLFQTSYTLENNGSVICIPNNGQCFCLAWLKSNGTNAEKLAANILQWITFALSALCLMFYGYQTWKSTCGWETIYVATIEMIKFIIEYFHEFDEPAVIYSSNGNKTVWLRYAEWLLTCPVLLIHLSNLTGLKDDYSKRTMGLLVSDVGCIVWGATSAMCTGWTKILFFLISLSYGMYTYFHAAKVYIEAFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEEED

SEQ ID NO: 258 - protein, 344 aa, Artificial Sequence
  Synthetic Polypeptide
MSRRPWLLALALAVALAAGSAGASTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVLLIHLSNLTGLKDDYSKRTMGLLVSDVGCIVWGATSAMCTGWTKILFFLISLSYGMYTYFHAAKVYIEAFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEEED

SEQ ID NO: 259 - protein, 344 aa, Artificial Sequence
  Synthetic Polypeptide
MSRRPWLLALALAVALAAGSAGASTGSDATVPVATQDGPDYVFHRAHERMLFQTSYTLENNGSVICIPNNGQCFCLAWLKSNGTNAEKLAANILQWITFALSALCLMFYGYQTWKSTCGWETIYVATIEMIKFIIEYFHEFDEPAVIYSSNGNKTVWLRYATWLLTCPVLLIHLSNLTGLKDDYSKRTMGLLVSDVGCIVWGATSAMCTGWTKILFFLISLSYGMYTYFHAAKVYIEAFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEEED

SEQ ID NO: 260 - protein, 344 aa, Artificial Sequence
  Synthetic Polypeptide
MSRRPWLLALALAVALAAGSAGASTGSDATVPVATQDGPDYVFHRAHERMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYATWLLTCPVLLIHLSNLTGLKDDYSKRTMGLLVSDVGCIVWGATSAMCTGWTKILFFLISLSYGMYTYFHAAKVYIEAFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEEED

SEQ ID NO: 261 - protein, 281 aa, Artificial Sequence
  Synthetic Polypeptide
MTTISEVCGVWALDNPECIEVSGTNDNVKMAQLCFCMVCVCQILFMASQYPKVGWEAIYLPSCECFLYGLASSGNGFIQLYDGRLIPWARYAAWICTCPSILLQINTIHKCKISHFNLNTFIVQADLIMNIMGVTGALTTNIAFKWIYFAIGCILFIFIVLVVYDIMTSAAKEWKAKGDSKGNLVSTRLILLRWIFIVSWCVYPLLWILSPQATCAVSEDVISVAHFICDAFAKNMFGFIMWRTLWRDLDGHWDISRHYPQSSYAKDGKEEEQMTAMSQTD

SEQ ID NO: 262 - protein, 287 aa, Artificial Sequence
  Synthetic Polypeptide
TMLEHLEGTMDGWYAENDLGQGAIIAHWVTFFFHMITTFYLGYVSFHSKGPGGKQPYFAGYHEENNIGIFVNLFAAISYFGKVVSDTHGHNYQNVGPFIIGLGNYRYADYMLTCPLLVMDLLFQLRAPYKITCAMLIFAVLMIGAVTNFYPGDDMKGPAVAWFCFGCFWYLIAYIFMAHIVSKQYGRLDYLAHGTKAEGALFSLKLAIITFFAIWVAFPLVWLLSVGTGVLSNEAAEICHCICDVVAKSVYGFALANFREQYDRELYGLLNSIGLDGEDVVQQLEKE

SEQ ID NO: 263 - protein, 296 aa, Artificial Sequence
  Synthetic Polypeptide
EEDCVTIRYFVENDFEGCIPGHFDQYSSHGSLHDIVKAALYICMVISILQILFYGFQWWRKTCGWEVWFVACIETSIYIIAITSEADSPFTLYLTNGQISPQLRYMEWLMTCPVILIALSNITGMAEEYNKRTMTLLTSDVCCIVLGMMSAASKPRLKGILYAVGWAFGAWTYWTALQVYRDAHKAVPKPLAWYVRAMGYVFFTSWLTFPGWFLLGPEGLEVVTGTVSTLMHACSDLISKNLWGFMDWHLRVLVARHHRKLFKAEEEHALKKGQTLEPGMPRSTSFVRGLGDDVEI

SEQ ID NO: 264 - protein, 291 aa, Artificial Sequence
  Synthetic Polypeptide
EYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEEYNKRTMALLVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEE

SEQ ID NO: 265 - protein, 286 aa, Artificial Sequence
  Synthetic Polypeptide
MGWKINPLYSDEVAILEICKENEMVFGPLWEQKLARALQWFTVILSAIFLAYYVYSTLRATCGWEELYVCTVEFTKVVVEVYLEYVPPFMIYQMNGQHTPWLRYMEWLLTCPVILIHLSNITGLNDEYSGRTMSLLTSDLGGIAFAVLSALAVGWQKGLYFGIGCIYGASTFYHAACIYIESYHTMPAGKCKRLVVAMCAVFFTSWFMFPALFLAGPECFDGLTWSGSTIAHTVADLLSKNIWGLIGHFLRVGIHEHILVHGDVRRPIEVTIFGKETSLNCFVEND

SEQ ID NO: 266 - protein, 285 aa, Artificial Sequence
  Synthetic Polypeptide
MFAINPEYMNETVLLDECTPIYLDIGPLWEQVVARVTQWFGVILSLVFLIYYIWNTYKATCGWEELYVCTVEFCKIIIELYFEYTPPAMIFQTNGQVTPWLRYAEWLLTCPVILIHLSNITGLNDDYSGRTMSLITSDLGGICMAVTAALSKGWLKALFFVIGCGYGASTFYNAACIYIESYYTMPQGICRRLVLWMAGVFFTSWFMFPGLFLAGPEGTQALSWAGTTIGHTVADLLSKNAWGMIGHFLRVEIHKHIIIHGDVRRPVTVKALGRQVSVNCFVDKE

SEQ ID NO: 267 - protein, 290 aa, Artificial Sequence
  Synthetic Polypeptide
YAGYTYCFSELAFGKLVMVPEADAGWLHSHGTQAEFVAATACQYTALSLALLLLSFYAYSAWKATCGWEEGYVCCVEVLFVTLEISNEFNSPATLYLSTGNYCYFLRYGEWLLSCPVILIHLSNLSGLKNDYSMRTMRLLVSCIGMLITGMAGGLGVGWVKWTLYFVSCAYSAQTYLQAAKCYVEVYATVPKGYCRTVVKLMAYAFFTAWGAYPILWAIGPEGLKYISGYSNTIAHTFCDILAKEIWTFLGHHLRIKIHEHILIHGDIRKKVQVRVAGELMNVEELMEEE

SEQ ID NO: 268 - protein, 290 aa, Artificial Sequence
  Synthetic Polypeptide
DAGYGYCFVEATGGYLVVGVEKKQAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIKLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEE

SEQ ID NO: 269 - protein, 284 aa, Artificial Sequence
  Synthetic Polypeptide
DAHGETSNATTAGADHGCFPHINHGTELQHKIAVGLQWFTVIVAIVQLIFYGWHSFKATTGWEEVYVCVIELVKCFIELFHEVDSPATVYQTNGGAVIWLRYSMWLLTCPVILIHLSNLTGLHEEYSKRTMTILVTDIGNIVWGITAAFTKGPLKILFFMIGLFYGVTCFFQIAKVYIESYHTLPKGVCRKICKIMAYVFFCSWLMFPVMFIAGHEGLGLITPYTSGIGHLILDLISKNTWGFLGHHLRVKIHEHILIHGDIRKTTTINVAGENMEIETFVDEE

SEQ ID NO: 270 - protein, 290 aa, Artificial Sequence
  Synthetic Polypeptide
DAGYGHWYQGTPNGTLVCSHEDNIAWLKNKGTDEEMLGANICMWMAFAACLLCLSFYAYSTWRATCGWEEVYVCLVEMVKVMIEVFHENDSPATLYLSTGNFIMWIRYGEWLLSCPVILIHLSNITGLQDQYSKRTMQLLVSDLGTITMGVTAALCGNYVKWIFFILGLCYGVNTYFHAAKVYIESYHIVPKGVCRVCVRVMAWCFFGAWTCYPLLFVFGPEGLGVLSYNASAIGHTIIDIFSKQVWGFVGHYLRIKIHEHIVIHGNLVKPTKVKVAGMEIDAEEMVEKD

SEQ ID NO: 271 - protein, 290 aa, Artificial Sequence
  Synthetic Polypeptide
DAGYQHFWTQRQNETVVCEHYTHASWLISHGTKAEKTAMIACQWFAFGSAVLILLLYAWHTWKATSGWEEVYVCCVELVKVLFEIYHEIHHPCTLYLVTGNFILWLRYGEWLLTCPVILIHLSNITGLKNDYNKRTMQLLVSDIGCVVWGVTAALCYDYKKWIFFCLGLVYGCNTYFHAAKVYIEGYHTVPKGECRIIVKVMAGVFYCSWTLFPLLFLLGPEGTGAFSAYGSTIAHTVADVLSKQLWGLLGHHLRVKIHEHIIIHGNLTVSKKVKVAGVEVETQEMVDST

SEQ ID NO: 272 - protein, 290 aa, Artificial Sequence
  Synthetic Polypeptide
DAKYDYCYVKAAYGELAIVETSRLPWLYSHGSDAEHQGALAMQWMAFALCIICLVFYAYHSWKATTGWEEVYVCVVELVKVLLEIYKEFESPASIYLPTANAALWLRYGEWLLTCPVILIHLSNITGLKDDYNKRTMQLLVSDIGCVVWGITAAFSVGWLKWVFFVLGLLYGSNTYFHAAKVYIESYHTVPKGHCRLIVRLMAYCFYVAWTMYPILFILGPEGLGHMSAYMSTALHGVADMLSKQIWGLLGHHLRVKIFEHILIHGDIRKTTTMQVGGQMVQVEEMVDEE

SEQ ID NO: 273 - protein, 293 aa, Artificial Sequence
  Synthetic Polypeptide
GFDELAKGAVVPEDHFVCGPADKCYCSAWLHSHGSKEEKTAFTVMQWIVFAVCIISLLFYAYQTWRATCGWEEVYVTIIELVHVCFGLWHEVDSPCTLYLSTGNMVLWLRYAEWLLTCPVILIHLSNLTGMKNDYNKRTMALLVSDVGCIVWGTTAALSTDFVKIIFFFLGLLYGFYTFYAAAKIYIEAYHTVPKGICRQLVRLQAYDFFFTWSMFPILFMVGPEGFGKITAYSSGIAHEVCDLLSKNLWGLMGHFIRVKIHEHILVHGNITKKTKVNVAGDMVELDTYVDQD

SEQ ID NO: 274 - protein, 294 aa, Artificial Sequence
  Synthetic Polypeptide
YSNYYFLNATNSTHKWVAGPEDDCFCKAWTFNRGSDEESVAAFAIAWVVFSLSVLQLLYYAYAQWRSTCGWEEVYVGIIELTHICIAIFREFDSPAMLYLSTGNFVVWARYASWLLSCPVILIHLSNLTGMKGNYSKRTMALLVSDIGTIVWGSTSAMSPHNHVKIIFFFLGLVFGLFTFYAAAKVYLEAYHTVPKGKCRNIVRFMAWTYYVTWALFPILFILGPEGFGHITYYGSSIGHYVLEIFSKNLWSGTGHYLRLKIHEHIILHGNLTKKTKINIAGEPLEVEEYVEAD

SEQ ID NO: 275 - protein, 294 aa, Artificial Sequence
  Synthetic Polypeptide
GNGGPSAMVSHYPNGSVLLESSGSCYCEDWYTSRGNHVEHSLSNACDWFAFAISVIFLVYYAWAAFNSSVGWEEIYVCTVELIKVSIDQFLSSNSPCTLYLSTGNRVLWIRYGEWLLTCPVILIHLSNVTGLKDNYSKRTMALLVSDIGTIVFGVTSAMCTGYPKVIFFILGCCYGANTFFNAAKVYLEAHHTLPKGSCRTLIRLMAYTYYASWGMFPILFVLGPESFGHMNMYQSNIAHTVIDLMSKNIWGMLGHFLRHKIREHILIHGDLRTTTTVNVAGEEMQVETMVAAE

SEQ ID NO: 276 - protein, 283 aa, Artificial Sequence
  Synthetic Polypeptide
MLGNGSAIVPIDQCFCLAWTDSLGSDTEQLVANILQWFAFGFSILILMFYAYQTWRATCGWEEVYVCCVELTKVIIEFFHEFDDPSMLYLANGHRVQWLRYAEWLLTCPVILIHLSNLTGLKDDYSKRTMRLLVSDVGTIVWGATSAMSTGYVKVIFFVLGCIYGANTFFHAAKVYIESYHVVPKGRPRTVVRIMAWLFFLSWGMFPVLFVVGPEGFDAISVYGSTIGHTIIDLMSKNCWGLLGHYLRVLIHQHIIIYGDIRKKTKINVAGEEMEVETMVDQE

SEQ ID NO: 277 - protein, 292 aa, Artificial Sequence
  Synthetic Polypeptide
RSLIGSSYTNLNNGSIVIPSDACFCMKWLKSKGSPVALKMANALQWAAFALSVIILIYYAYATWRTTCGWEEVYVCCVELTKVVIEFFHEFDEPGMLYLANGNRVLWLRYGEWLLTCPVILIHLSNLTGLKDDYNKRTMRLLVSDVGTIVWGATSAMCTGWTKILFFLISLSYGMYTYFHAAKVYIEAFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEE

SEQ ID NO: 278 - protein, 292 aa, Artificial Sequence
  Synthetic Polypeptide
RSLIGSSYTNLNNGSIVIPSDACFCMKWLKSKGSPVALKMANALQWAAFALSVIILIYYAYATWRTTCGWEEVYVCCVELTKVVIEFFHEFDEPGMLYLANGNRVLWLRYGEWLLTCPVILIHLSNLTGLKDDYSKRTMGLLVSDVGCIVWGATSAMCTGWTKILFFLISLSYGMYTYFHAAKVYIEAFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEE

SEQ ID NO: 279 - protein, 292 aa, Artificial Sequence
  Synthetic Polypeptide
RSLIGSSYTNLNNGSIVIPSDACFCMKWLKSKGSPVALKMANALQWAAFALSVIILIYYAYATWRTTCGWEEVYVCCVELTKVVIEFFHEFDEPGMLYLANGNRVLWLRYGEWLLTCPVLLIHLSNLTGLKDDYSKRTMGLLVSDVGCIVWGATSAMCTGWTKILFFLISLSYGMYTYFHAAKVYIEAFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEE

SEQ ID NO: 280 - protein, 292 aa, Artificial Sequence
  Synthetic Polypeptide
RSLIGSSYTNLNNGSIVIPSDACFCMKWLKSKGSPVALKMANALQWAAFALSVIILIYYAYATWRTTCGWEEVYVCCVELTKVVIEFFHEFDEPGMLYLANGNRVLWLRYGEWLLTCPVILIHLSNLTGLKDDYNKRTMRLLVSDVGTIVWGATAAMSTGYIKVIFFLLGCMYGANTFFHAAKVYIESYHTVPKGLCRQLVRAMAWLFFVSWGMFPVLFLLGPEGFGHLSVYGSTIGHSILDLIAKNMWGVLGNYLRVKIHEHILLYGDIRKKQKITIAGQEMEVETLVAEE

SEQ ID NO: 281 - protein, 293 aa, Artificial Sequence
  Synthetic Polypeptide
ARSLIVRYPTDLGNGTVCMPRGQCYCEGWLRSRGTSIEKTIAITLQWVVFALSVIILIYYAYATWRTTCGWEEVYVCCVELTKVVIEFFHEFDEPGMLYLANGNRVLWLRYGEWLLTCPVILIHLSNLTGLKDDYNKRTMRLLVSDVGTIVWGATAAMSTGYIKVIFFLLGCMYGANTFFHAAKVYIEAFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEE

SEQ ID NO: 282 - protein, 293 aa, Artificial Sequence
  Synthetic Polypeptide
ARSLIVRYPTDLGNGTVCMPRGQCYCEGWLRSRGTSIEKTIAITLQWVVFALSVACLGWYAYQAWRATCGWEEVYVALIEMMKSIIEAFHEFDSPATLWLSSGNGVVWMRYGEWLLTCPVLLIHLSNLTGLKDDYSKRTMGLLVSDVGCIVWGATSAMCTGWTKILFFLISLSYGMYTYFHAAKVYIEAFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEE

SEQ ID NO: 283 - protein, 293 aa, Artificial Sequence
  Synthetic Polypeptide
ARSLIVRYPTDLGNGTVCMPRGQCYCEGWLRSRGTSIEKTIAITLQWVVFALSVACLGWYAYQAWRATCGWEEVYVALIEMMKSIIEAFHEFDSPAMLYLANGNRVLWLRYGEWLLTCPVILIHLSNLTGLKDDYNKRTMRLLVSDVGTIVWGATAAMSTGYIKILFFLISLSYGMYTYFHAAKVYIEAFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEE

SEQ ID NO: 284 - protein, 293 aa, Artificial Sequence
  Synthetic Polypeptide
ARSLIVRYPTDLGNGTVCMPRGQCYCEGWLRSRGTSIEKTIAITLQWVVFALSVACLGWYAYQAWRATCGWEEVYVALIEMMKSIIEAFHEFDSPATLWLSSGNGVVWMRYGEWLLTCPVLLIHLSNLTGLKDDYSKRTMGLLVSDVGCIVWGATSAMCTGYIKVIFFLLGCMYGANTFFHAAKVYIESYHTVPKGLCRQLVRAMAWLFFVSWGMFPVLFLLGPEGFGHLSVYGSAIGHSILDLIAKNMWGVLGNYLRVKIHEHILLYGDIRKKQKITIAGQEMEVETLVAEE

SEQ ID NO: 285 - protein, 293 aa, Artificial Sequence
  Synthetic Polypeptide
ARSLIVRYPTDLGNGTVCMPRGQCYCEGWLRSRGTSIEKTIAITLQWVVFALSVACLGWYAYQAWRATCGWEEVYVALIEMMKSIIEAFHEFDSPATLWLSSGNGVVWMRYGEWLLTCPVILIHLSNLTGLKDDYNKRTMRLLVSDVGTIVWGATAAMSTGYIKVIFFLLGCMYGANTFFHAAKVYIESFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEE

SEQ ID NO: 286 - protein, 293 aa, Artificial Sequence
  Synthetic Polypeptide
ARSLIVRYPTDLGNGTVCMPRGQCYCEGWLRSRGTSIEKTIAITLQWVVFALSVACLGWYAYQAWRATCGWEEVYVALIEMMKSIIEAFHEFDSPATLWLSSGNGVVWMRYGEWLLTCPVLLIHLSNLTGLKDDYSKRTMGLLVSDVGCIVWGATSAMCTGWTKILFFLISLSYGMYTYFHAAKVYIEAFHTVPKGICRELVRAMAWLFFVSWGMFPVLFLLGPEGFGHLSVYGSTIGHTIIDLLSKNCWGLLGHFLRLKIHEHILLYGDIRKVQKIRVAGEELEVETLMTEE

SEQ ID NO: 287 - protein, 293 aa, Artificial Sequence
  Synthetic Polypeptide
ARSLIVRYPTDLGNGTVCMPRGQCYCEGWLRSRGTSIEKTIAITLQWVVFALSVACLGWYAYQAWRATCGWEEVYVALIEMMKSIIEAFHEFDSPATLWLSSGNGVVWMRYGEWLLTCPVLLIHLSNLTGLKDDYNKRTMRLLVSDVGTIVWGATAAMSTGYIKVIFFLLGCMYGANTFFHAAKVYIESYHTVPKGLCRQLVRAMAWLFFVSWGMFPVLFLLGPEGFGHLSVYGSTIGHTIIDLLSKNCWGLLGHFLRLKIHEHILLYGDIRKVQKIRVAGEELEVETLMTEE

SEQ ID NO: 288 - protein, 291 aa, Artificial Sequence
  Synthetic Polypeptide
ELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYAEWLLTSPVILIHLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 289 - protein, 291 aa, Artificial Sequence
  Synthetic Polypeptide
ELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYAEWLLTCPVICIHLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 290 - protein, 291 aa, Artificial Sequence
  Synthetic Polypeptide
ELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYAEWLLTAPVILIHLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 291 - protein, 291 aa, Artificial Sequence
  Synthetic Polypeptide
ELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYAEWLLTTPVILIHLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 292 - protein, 291 aa, Artificial Sequence
  Synthetic Polypeptide
ELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYAEWLLTCPVILIHLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 293 - protein, 291 aa, Artificial Sequence
  Synthetic Polypeptide
ELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYAEWLLTCPVILIHLSNLTGLSNDYSRRTMGLLVSDIGCIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 294 - protein, 291 aa, Artificial Sequence
  Synthetic Polypeptide
ELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYATWLLTCPVILIHLSNLTGLSNDYSRRTMGLLVSDIGCIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 295 - protein, 291 aa, Artificial Sequence
  Synthetic Polypeptide
ELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYAEWLLTCPVILIRLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 296 - protein, 291 aa, Artificial Sequence
  Synthetic Polypeptide
ELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYATWLLTCPVILIRLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 297 - protein, 291 aa, Artificial Sequence
  Synthetic Polypeptide
ELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYAAWLLTCPVILIRLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 298 - protein, 291 aa, Artificial Sequence
  Synthetic Polypeptide
ELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYAAWLLTCPVILIHLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 299 - protein, 291 aa, Artificial Sequence
  Synthetic Polypeptide
ELLFVTNPVVVNGSVLVPEDQCYCAGWIESRGTNGAQTASNVLQWLAAGFSILLLMFYAYQTWKSTCGWEEIYVCAIEMVKVILEFFFEFKNPSMLYLATGHRVQWLRYATWLLTCPVILIHLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 300 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVCAIEMVKVILEFFFEFKNPSMLYLATGHRVQWLRYAEWLLTCPVILIHLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 301 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGICRDLVRYLAWLYFCSWAMFPVLFLLGPEGFGHINQFNSAIAHAILDLASKNAWSMMGHFLRVKIHEHILLYGDIRKKQKVNVAGQEMEVETMVHEE

SEQ ID NO: 302 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFLLGPEGFGHINQFNSAIAHAILDLASKNAWSMMGHFLRVKIHEHILLYGDIRKKQKVNVAGQEMEVETMVHEE

SEQ ID NO: 303 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFLLGPEGFGHINQFNSAIAHAILDLASKNCWGLLGHYLRVLIHEHILIHGDIRKTTKLNIGGTEIEVETLVEDE

SEQ ID NO: 304 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGICRDLVRYLAWLYFCSWAMFPVLFLLGPEGFGVLSVYGSTVGHTIIDLMSKNCWGLLGHYLRVLIHEHILIHGDIRKTTKLNIGGTEIEVETLVEDE

SEQ ID NO: 305 - protein, 294 aa, Artificial Sequence; identical to SEQ ID NO: 304
  Synthetic Polypeptide

SEQ ID NO: 306 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 307 - protein, 294 aa, Artificial Sequence; identical to SEQ ID NO: 306
  Synthetic Polypeptide

SEQ ID NO: 308 - protein, 294 aa, Artificial Sequence; identical to SEQ ID NO: 306
  Synthetic Polypeptide

SEQ ID NO: 309 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 310 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 311 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLSNDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 312 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYSRRTMGLLVSDIGTIVWGATSAMATGYVKVIFFCLGLCYGANTFFHAAKAYIEGYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 313 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGICRDLVRVMAWTFFVAWGMFPVLFLLGTEGFGHISPYGSAIGHSILDLIAKNMWGVLGNYLRVKIHEHILLYGDIRKKQKITIAGQEMEVETLVAEE

SEQ ID NO: 314 - protein, 294 aa, Artificial Sequence
  Synthetic Polypeptide
RMLFQTSYTLENNGSVICIPNNGQCFCLAWLKSNGTNAEKLAANILQWVVFALSVACLGWYAYQAWRATCGWEEVYVALIEMMKSIIEAFHEFDSPATLWLSSGNGVVWMRYGEWLLTCPVLLIHLSNLTGLKDDYSKRTMGLLVSDVGCIVWGATSAMCTGWTKILFFLISLSYGMYTYFHAAKVYIEAFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEE

SEQ ID NO: 315 - protein, 294 aa, Artificial Sequence
  Synthetic Polypeptide
VGLFQTSYTLENNGSVICIPNNGQCFCLAWLKSNGTNAEKLAANILQWVVFALSVACLGWYAYQAWRATCGWEEVYVALIEMMKSIIEAFHEFDSPATLWLSSGNGVVWMRYGSWLLTCPVILIHLSNLTGLKDDYSKRTMGLLVSDVGCIVWGATSAMCTGWTKILFFLISLSYGMYTYFHAAKVYIEAFHTVPKGLCRQLVRAMAWLFFVSWGMFPVLFLLGPEGFGHISPYGSAIGHSILDLIAKNMWGVLGNYLRVKIHEHILLYGDIRKKQKITIAGQEMEVETLVAEE

SEQ ID NO: 316 - protein, 294 aa, Artificial Sequence
  Synthetic Polypeptide
RMLFQTSYTLENNGSVICIPNNGQCFCLAWLKSNGTNAEKLAANILQWVVFALSVACLGWYAYQAWRATCGWEEVYVALIEMMKSIIEAFHEFDSPATLWLSSGNGVVWMRYGEWLLTCPVILIHLSNLTGLKDDYSKRTMGLLVSDVGCIVWGATSAMCTGWTKILFFLISLSYGMYTYFHAAKVYIEAFHTVPKGLCRQLVRAMAWLFFVSWGMFPVLFLLGPEGFGHISPYGSAIGHSILDLIAKNMWGVLGNYLRVKIHEHILLYGDIRKKQKITIAGQEMEVETLVAEE

SEQ ID NO: 317 - protein, 294 aa, Artificial Sequence
  Synthetic Polypeptide
RMLFQTSYTLENNGSVICIPNNGQCFCLAWLKSNGTNAEKLAANILQWVVFALSVACLGWYAYQAWRATCGWEEVYVALIEMMKSIIEAFHEFDSPATLWLSSGNGVVWMRYGEWLLTCPVLLIHLSNLTGLKDDYSKRTMGLLVSDVGCIVWGATSAMCTGWTKILFFLISLSYGMYTYFHAAKVYIEAFHTVPKGLCRQLVRAMAWLFFVSWGMFPVLFLLGPEGFGHISPYGSAIGHSILDLIAKNMWGVLGNYLRVKIHEHILLYGDIRKKQKITIAGQEMEVETLVAEE

SEQ ID NO: 318 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWETIYVATIEMIKFIIEYFHEFDEPAVIYSSNGNKTVWLRYAEWLLTCPVLLIHLSNLTGLKDDYSKRTMGLLVSDVGCIVWGATSAMCTGWTKILFFLISLSYGMYTYFHAAKVYIEAFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEE

SEQ ID NO: 319 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVLLIHLSNLTGLKDDYSKRTMGLLVSDVGCIVWGATSAMCTGWTKILFFLISLSYGMYTYFHAAKVYIEAFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEE

SEQ ID NO: 320 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWETIYVATIEMIKFIIEYFHEFDEPAVIYSSNGNKTVWLRYATWLLTCPVLLIHLSNLTGLKDDYSKRTMGLLVSDVGCIVWGATSAMCTGWTKILFFLISLSYGMYTYFHAAKVYIEAFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEE

SEQ ID NO: 321 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYATWLLTCPVLLIHLSNLTGLKDDYSKRTMGLLVSDVGCIVWGATSAMCTGWTKILFFLISLSYGMYTYFHAAKVYIEAFHTVPKGICRELVRVMAWTFFVAWGMFPVLFLLGTEGFGHISPYGSAIGHSILDLIAKNMWGVLGNYLRVKIHEHILLYGDIRKKQKITIAGQEMEVETLVAEE

SEQ ID NO: 322 - protein, 294 aa, Artificial Sequence; identical to SEQ ID NO: 306
  Synthetic Polypeptide

SEQ ID NO: 323 - protein, 294 aa, Artificial Sequence
  Synthetic Polypeptide
RMLFQTSYTLENNGSVICIPNNGQCFCLAWLKSNGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEE

SEQ ID NO: 324 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEE

SEQ ID NO: 325 - protein, 291 aa, Artificial Sequence
  Synthetic Polypeptide
EYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEE

SEQ ID NO: 326 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWLMFPGLFIFGPEGMHTLSPYANSIGHSICDIIAKEFWTFLAHHLRIKIHEHILIHGDIRKTTKMEIGGEEVEVEEFVEEE

SEQ ID NO: 327 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHIIMYGDIRRPVSSQFLGRKVDVLAFVTEE

SEQ ID NO: 328 - protein, 293 aa, Artificial Sequence
  Synthetic Polypeptide
GFDELAKGAVVPEDHFVCGPADKCYCSAWLHSRGTPGEKIGAQVCQWITFALSALCLMFYGYQTWKSTCGWEEIYVATIEMIKFIIEYFHEFDSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEE

SEQ ID NO: 329 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSEPAVIYSSNGNKTVWLRYAEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEE

SEQ ID NO: 330 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDLGTICMGVTAALATGWVKWLFYCIGLVYGTQTFYNAGIIYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 331 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEAYHTVPKGRCRQVVTGMAWLFFVSWGSYPILWAVGPEGLLKLSPYANSIGHSICDIIAKEFWTFLAHHLRIKIHEHILIHGDIRKTTKMEIGGEEVEVEEFVEEE

SEQ ID NO: 332 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGMFPILFILGPEGFGVLSPYANSIGHSICDIIAKEFWTFLAHHLRIKIHEHILIHGDIRKTTKMEIGGEEVEVEEFVEEE

SEQ ID NO: 333 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKLNIGGTEIEVETLVEDE

SEQ ID NO: 334 - protein, 293 aa, Artificial Sequence
  Synthetic Polypeptide
GFDELAKGAVVPEDHFVCGPADKCYCSAWLHSRGTNAEKLAANILQWIAVFLSALFLAFYGWHAYKASVGWEEVYVCSVELIKVILEIYFEFTSPATVYLSTGNHAYCLRYFEWLLTCPVILIHLSNLTGLANDYNKRTMGLLVSCVGMIVFGMAAGLATDWLKWLLYIVSCIYGGYMYFQAAKCYVEAYHTVPKGRCRQVVTGMAWLFFVSWGSYPILWAVGPEGLLKLSVAGSTIGHTIADLLSKNIWGLLGHFLRIKIHEHIIMYGDIRRPVSSQFLGRKVDVLAFVTEE

SEQ ID NO: 335 - protein, 294 aa, Artificial Sequence
  Synthetic Polypeptide
RMLFQTSYTLENNGSVICIPNNGQCFCLAWLKSNGALWEQETARGFQWFAVFLSALFLAFYGWHAYKASVGWEEVYVCSVELIKVILEIYFEFTEPAVIYSSGGNKTVWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEE

SEQ ID NO: 336 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSGGNKTVWLRYAEWLLTCPVILIHLSNLTGLANDYNKRTMGLLVSDIGTIVWGTTAALATGWVKWLFYCIGLVYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 337 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMALLVSDIGTIVWGTTAALSKGYVRVIFFLMGLCYGTQTFYNAGIIYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 338 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHIIMYGDIRRPVSSQFLGRKVDVLAFVTEE

SEQ ID NO: 339 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVESYYIMPAGGCKKLVLAMTAVYYSSWGSYPILWAVGPEGLLKLSPYANSIGHSICDIIAKEFWTFLAHHLRIKIHEHILIHGDIRKTTKMEIGGEEVEVEEFVEEE

SEQ ID NO: 340 - protein, 294 aa, Artificial Sequence
  Synthetic Polypeptide
RMLFQTSYTLENNGSVICIPNNGQCFCLAWLKSNGTPGEKIGAQVCQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 341 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNITGLSEAYNKRTMALLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 342 - protein, 293 aa, Artificial Sequence
  Synthetic Polypeptide
GFDELAKGAVVPEDHFVCGPADKCYCSAWLHSRGTNAEKLAANILQWITVALSALCLMFYGWHAYKASVGWEEVYVCSVELIKVILEIYFEFTSPATVYLSGGNHAYCLRYFEWLLTCPVILIHLSNLSGLSEAYNKRTMGLIVSCVGMIVFGMAAGLATGWVKWLFYCIGLVYGIYTFFNAAKVYIEANHSVPKGRCRQVVTGMAWLFFVSWGMFPILFILGPEGFGVLSVYGSTVGHTIIDLMSKNCWGLLGHYLRVLIHEHILIHGDIRKTTKMEIGGEEVEVEEFVEEE

SEQ ID NO: 343 - protein, 291 aa, Artificial Sequence
  Synthetic Polypeptide
EYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNLTGLANDYNKRTMGLLVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEE

SEQ ID NO: 344 - protein, 291 aa, Artificial Sequence
  Synthetic Polypeptide
EYHAPAGYQVNPPYHPVHGYEEQCSSIYIYYGALWEQETARGFQWFAVFLSALFLAFYGWHAYKASVGWEEVYVCSVELIKVILEIYFEFTSPATVYLSTGNHAYCLRYFEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEE

SEQ ID NO: 345 - protein, 291 aa, Artificial Sequence
  Synthetic Polypeptide
EYHAPAGYQVNPPYHPVHGYEEQCSSIYIYYGALWEQETARGFQWFTFALSALCLMFYGYQTWKSTCGWEEIYVATIEMIKFIIEYFHEFDSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEE

SEQ ID NO: 346 - protein, 291 aa, Artificial Sequence
  Synthetic Polypeptide
EYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLSCPVILIRLSNLSGLKNDYSKRTMGLIVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEE

SEQ ID NO: 347 - protein, 294 aa, Artificial Sequence
  Synthetic Polypeptide
RMLFQTSYTLENNGSVICIPNNGQCFCLAWLKSNGALWEQETARGFQWFTFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 348 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDSPAMLFLYGGNITPWLRYAEWLLTCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 349 - protein, 294 aa, Artificial Sequence
  Synthetic Polypeptide
RMLFQTSYTLENNGSVICIPNNGQCFCLAWLKSNGTPGEKIGAQVCQWIAFSIAIALLTFYGYQTWKSTCGWEEIYVATIEMIKFIIEYFHEFDEPAVIYSSNGNKTVWLRYAEWLLTCPVILIRLSNLTGLANDYNKRTMGLLVSDIGTIVWGTTAALSKGYVRVIFFLMGLCYGIYTFFNAAKVYIEAYHTVPKGRCRQVVTGMAWLFFVSWGSYPILFILGPEGFGVLSPYANSIGHSICDIIAKEFWTFLAHYLRVLIHEHILIHGDIRKTTKLNIGGTEIEVETLVEDE

SEQ ID NO: 350 - protein, 294 aa, Artificial Sequence
  Synthetic Polypeptide
RMLFQTSYTLENNGSVICIPNNGQCFCLAWLKSNGTPGEKIGAQVCQWIAFSIAIALLTFYGFSAWKATCGWEEVYVCCVEVLFVTLEIFKEFSSPATVYLSTGNHAYCLRYFEWLLTCPVILIHLSNLTGLANDYNKRTMGLLVSCVGMIVFGMAAGLATDWLKWLLYIVSCIYGGYMYFQAAKCYVEAYHTVPKGRCRQVVTGMAWLFFVSWLMFPGLFIFGPEGMHTLSVAGSTIGHTIADLLSKNIWGLLGHFLRIKIHEHIIMYGDIRRPVSSQFLGRKVDVLAFVTEE

SEQ ID NO: 351 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEAYHTVPKGRCRQVVTGMAWLFFVSWGSYPILWAVGPEGLLKLSPYANSIGHSICDIIAKEFWTFLAHHLRIKIHEHILIHGDIRKTTKLNIGGTEIEVETLVEDE

SEQ ID NO: 352 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKMEIGGEEVEVEEFVEEE

SEQ ID NO: 353 - protein, 294 aa, Artificial Sequence
  Synthetic Polypeptide
RMLFQTSYTLENNGSVICIPNNGQCFCLAWLKSNGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEE

SEQ ID NO: 354 - protein, 291 aa, Artificial Sequence
  Synthetic Polypeptide
EYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWGSYPILWAVGPEGLLKLSVAGSTIGHTIADLLSKNIWGLLGHFLRIKIHEHIIMYGDIRRPVSSQFLGRKVDVLAFVTEE

SEQ ID NO: 355 - protein, 293 aa, Artificial Sequence
  Synthetic Polypeptide
GFDELAKGAVVPEDHFVCGPADKCYCSAWLHSRGALWEQETARGFQWFAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEE

SEQ ID NO: 356 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSCVGMIVFGMAAGLATDWLKWLLYIVSCIYGGYMYFQAAKCYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 357 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPAMLFLYGGNITPWLRYAEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEE

SEQ ID NO: 358 - protein, 291 aa, Artificial Sequence
  Synthetic Polypeptide
EYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSCVGMIVFGMAAGLATDWLKWLLYIVSCIYGGYMYFQAAKCYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEE

SEQ ID NO: 359 - protein, 291 aa, Artificial Sequence
  Synthetic Polypeptide
EYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWGMFPILFILGPEGFGVLSVAGSTIGHTIADLLSKNIWGLLGHFLRIKIHEHIIMYGDIRRPVSSQFLGRKVDVLAFVTEE

SEQ ID NO: 360 - protein, 294 aa, Artificial Sequence
  Synthetic Polypeptide
RMLFQTSYTLENNGSVICIPNNGQCFCLAWLKSNGTNAEKLAANILQWITFALSALCLMFYGFSAWKATCGWEEVYVCCVEVLFVTLEIFKEFSEPAVIYSSNGNKTVWLRYAEWLLSCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 361 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGHCRMVVKLMAYAYFASWGMFPILFILGPEGFGVLSVYGSTVGHTIIDLMSKNCWGLLGHHLRIKIHEHILIHGDIRKTTKLNIGGTEIEVETLVEDE

SEQ ID NO: 362 - protein, 291 aa, Artificial Sequence
  Synthetic Polypeptide
EYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPCLRYFEWLLTCPVILIHLSNITGLSEAYNKRTMALIVSCVGMIVFGMAAGLATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEE

SEQ ID NO: 363 - protein, 293 aa, Artificial Sequence
  Synthetic Polypeptide
GFDELAKGAVVPEDHFVCGPADKCYCSAWLHSRGTPGEKIGAQVCQWIAVSIAIALLTFYGWHAYKASVGWEEVYVCSVELIKVILEIYFEFTSPATVYLSTGNHAYCLRYFEWLLTCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEE

SEQ ID NO: 364 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLSEAYNKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEE

SEQ ID NO: 365 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNITGLKNDYSKRTMGLIVSCVGMIVFGMAAGLATDWLKWLLYIVSCIYGGYMYFQAAKCYVESYYIMPKGHCRMVVKLMAYAYFASWGSYPILWAVGPEGLLKLSPYANSIGHSICDIIAKEFWTFLAHHLRIKIHEHIIMYGDIRRPVSSQFLGRKVDVLAFVTEE

SEQ ID NO: 366 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLSEAYNKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 367 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPAGGCKKLVLAMTAVYYSSWLSYPILWAVGPEGLLKLSPYANSIGHSICDIIAKEFWTFLAHFLRIKIHEHILIHGDIRKTTKMEIGGEEVEVEEFVEEE

SEQ ID NO: 368 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSGGNHAYCLRYFEWLLSCPVILIRLSNLSGLKNDYSKRTMGLIVSCVGMIVFGMAAGLATGWVKWLFYCIGLVYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEE

SEQ ID NO: 369 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMALIVSCVGMIVFGMAAGLATDWLKWLLYIVSCIYGTQTFYNAGIIYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEE

SEQ ID NO: 370 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILFILGPEGFGVLSPYANSIGHSICDIIAKEFWTFLAHHLRIKIHEHILIHGDIRKTTKMEIGGEEVEVEEFVEEE

SEQ ID NO: 371 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLANDYNKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEE

SEQ ID NO: 372 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLTGLKNDYSKRTMGLIVSCVGMIVFGMAAGLATDWLKWLLYIVSCIYGGYMYFQAAKCYVEAYHTVPKGHCRMVVKLMAYAYFASWGSYPILWAVGPEGLLKLSPYANSIGHSICDIIAKEFWTFLAHHLRIKIHEHILIHGDIRKTTKLNIGGTEIEVETLVEDE

SEQ ID NO: 373 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNITGLANDYNKRTMGLLVSDIGTIVWGTTAALSKGYVRVIFFLMGLCYGIYTFFNAAKVYIESYYIMPKGRCRQVVTGMAWLFFVSWGMFPILFILGPEGFGVLSVYGSTVGHTIIDLMSKNCWGLLGHYLRVLIHEHIIMYGDIRRPVSSQFLGRKVDVLAFVTEE

SEQ ID NO: 374 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGRCRQVVTGMAWLFFVSWGSYPILWAVGPEGLLKLSPYANSIGHSICDIIAKEFWTFLAHYLRVLIHEHILIHGDIRKTTKMEIGGEEVEVEEFVEEE

SEQ ID NO: 375 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSNGNHAYCLRYFEWLLSCPVILIRLSNLSGLKNDYSKRTMGLIVSCVGMIVFGMAAGLSKGYVRVIFFLMGLCYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEE

SEQ ID NO: 376 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGIYTFFNAAKVYIEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEE

SEQ ID NO: 377 - protein, 293 aa, Artificial Sequence
  Synthetic Polypeptide
GFDELAKGAVVPEDHFVCGPADKCYCSAWLHSRGALWEQETARGFQWFAVFLSALFLAFYGWHAYKASVGWEEVYVCSVELIKVILEIYFEFTSPATVYLSGGNHAYWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEE

SEQ ID NO: 378 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLKNDYSKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 379 - protein, 294 aa, Artificial Sequence
  Synthetic Polypeptide
RMLFQTSYTLENNGSVICIPNNGQCFCLAWLKSNGTNAEKLAANILQWITVALSALCLMFYGWHAYKASVGWEEVYVCSVELIKVILEIYFEFTEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 380 - protein, 291 aa, Artificial Sequence
  Synthetic Polypeptide
EYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLKNDYSKRTMALLVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEE

SEQ ID NO: 381 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVCLRYFEWLLTCPVILIHLSNLTGLANDYNKRTMGLIVSCVGMIVFGMAAGLSKGYVRVIFFLMGLCYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 382 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSTGNKTVWLRYAEWLLTCPVILIHLSNLTGLANDYNKRTMGLLVSDIGTIVWGTTAALATDWLKWLLYIVSCIYGIYTFFNAAKVYIEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 383 - protein, 294 aa, Artificial Sequence
  Synthetic Polypeptide
RMLFQTSYTLENNGSVICIPNNGQCFCLAWLKSNGTPGEKIGAQVCQWIAFSIAIALLTFYGFSAWKATCGWEEVYVCCVEVLFVTLEIFKEFSEPAVIYSSTGNKTVCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEE

SEQ ID NO: 384 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGGYMYFQAAKCYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 385 - protein, 294 aa, Artificial Sequence
  Synthetic Polypeptide
RMLFQTSYTLENNGSVICIPNNGQCFCLAWLKSNGTPGEKIGAQVCQWIAFSIAIALLTFYGYQTWKSTCGWEEIYVATIEMIKFIIEYFHEFDEPAVIYSSNGNKTVCLRYFEWLLTCPVILIRLSNLTGLKNDYSKRTMGLIVSCVGMIVFGMAAGLSKGYVRVIFFLMGLCYGGYMYFQAAKCYVEAYHTVPKGRCRQVVTGMAWLFFVSWGSYPILWAVGPEGLLKLSPYANSIGHSICDIIAKEFWTFLAHYLRVLIHEHILIHGDIRKTTKLNIGGTEIEVETLVEDE

SEQ ID NO: 386 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSTGNKTVCLRYFEWLLTCPVILIHLSNITGLKNDYSKRTMGLIVSCVGMIVFGMAAGLATDWLKWLLYIVSCIYGGYMYFQAAKCYVESYYIMPAGGCKKLVLAMTAVYYSSWLMFPILWAVGPEGLLKLSVYGSTVGHTIIDLMSKNCWGLLGHFLRIKIHEHIIMYGDIRRPVSSQFLGRKVDVLAFVTEE

SEQ ID NO: 387 - protein, 294 aa, Artificial Sequence
  Synthetic Polypeptide
RMLFQTSYTLENNGSVICIPNNGQCFCLAWLKSNGALWEQETARGFQWFAFFLSALFLAFYGFSAWKATCGWEEVYVCCVEVLFVTLEIFKEFSEPAVIYSSNGNKTVCLRYFEWLLSCPVILIHLSNITGLKNDYSKRTMGLIVSCVGMIVFGMAAGLSKGYVRVIFFLMGLCYGIYTFFNAAKVYIESYYIMPKGRCRQVVTGMAWLFFVSWGMFPILFILGPEGFGVLSVAGSTIGHTIADLLSKNIWGLLGHYLRVLIHEHIIMYGDIRRPVSSQFLGRKVDVLAFVTEE

SEQ ID NO: 388 - protein, 291 aa, Artificial Sequence
  Synthetic Polypeptide
EYHAPAGYQVNPPYHPVHGYEEQCSSIYIYYGALWEQETARGFQWFAFFLSALFLAFYGYQTWKSTCGWEEIYVATIEMIKFIIEYFHEFDSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEE

SEQ ID NO: 389 - protein, 291 aa, Artificial Sequence
  Synthetic Polypeptide
EYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWLMFPILFILGPEGFGVLSVAGSTIGHTIADLLSKNIWGLLGHFLRIKIHEHIIMYGDIRRPVSSQFLGRKVDVLAFVTEE

SEQ ID NO: 390 - protein, 294 aa, Artificial Sequence
  Synthetic Polypeptide
RMLFQTSYTLENNGSVICIPNNGQCFCLAWLKSNGALWEQETARGFQWFAFFLSALFLAFYGYQTWKSTCGWEEIYVATIEMIKFIIEYFHEFDEPAVIYSSNGNKTVWLRYAEWLLTCPVILIHLSNLTGLANDYNKRTMGLLVSDIGTIVWGTTAALSKGYVRVIFFLMGLCYGIYTFFNAAKVYIEAYHTVPKGRCRQVVTGMAWLFFVSWGMFPILFILGPEGFGVLSVAGSTIGHTIADLLSKNIWGLLGHYLRVLIHEHILIHGDIRKTTKLNIGGTEIEVETLVEDE

SEQ ID NO: 391 - protein, 291 aa, Artificial Sequence
  Synthetic Polypeptide
EYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNLTGLSEAYNKRTMALLVSDLGTICMGVTAALATGWVKWLFYCIGLVYGTQTFYNAGIIYVEAYHTVPAGGCKKLVLAMTAVYYSSWLMFPGLFIFGPEGMHTLSVAGSTIGHTIADLLSKNIWGLLGHFLRIKIHEHILIHGDIRKTTKLNIGGTEIEVETLVEDE

SEQ ID NO: 392 - protein, 291 aa, Artificial Sequence
  Synthetic Polypeptide
EYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPKGRCRQVVTGMAWLFFVSWGMFPGLFIFGPEGMHTLSVAGSTIGHTIADLLSKNIWGLLGHYLRVLIHEHIIMYGDIRRPVSSQFLGRKVDVLAFVTEE

SEQ ID NO: 393 - protein, 291 aa, Artificial Sequence
  Synthetic Polypeptide
EYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDIGTIVWGTTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEE

SEQ ID NO: 394 - protein, 291 aa, Artificial Sequence
  Synthetic Polypeptide
EYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYNGNITPWLRYAEWLLTCPVILIHLSNITGLSEAYNKRTMALLVSDLGTICMGVTAALSKGYVRVIFFLMGLCYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEE

SEQ ID NO: 395 - protein, 291 aa, Artificial Sequence
  Synthetic Polypeptide
EYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWLMFPILWAVGPEGLLKLSVAGSTIGHTIADLLSKNIWGLLGHFLRIKIHEHIIMYGDIRRPVSSQFLGRKVDVLAFVTEE

SEQ ID NO: 396 - protein, 291 aa, Artificial Sequence
  Synthetic Polypeptide
EYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLANDYNKRTMALLVSDLGTICMGVTAALATGWVKWLFYCIGLVYGTQTFYNAGIIYVESYYIMPAGGCKKLVLAMTAVYYSSWLMFPGLFIFGPEGMHTLSVAGSTIGHTIADLLSKNIWGLLGHFLRIKIHEHIIMYGDIRRPVSSQFLGRKVDVLAFVTEE

SEQ ID NO: 397 - protein, 291 aa, Artificial Sequence
  Synthetic Polypeptide
EYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWLMFPGLFIFGPEGMHTLSVAGSTIGHTIADLLSKNIWGLLGHFLRIKIHEHIIMYGDIRRPVSSQFLGRKVDVLAFVTEE

SEQ ID NO: 398 - protein, 294 aa, Artificial Sequence
  Synthetic Polypeptide
RMLFQTSYTLENNGSVICIPNNGQCFCLAWLKSNGTPGEKIGAQVCQWIAFSIAIALLTFYGYQTWKSTCGWEEIYVATIEMIKFIIEYFHEFDEPAVIYSSNGNKTVCLRYFEWLLTCPVILIRLSNLTGLANDYNKRTMGLIVSCVGMIVFGMAAGLSKGYVRVIFFLMGLCYGGYMYFQAAKCYVEAYHTVPKGRCRQVVTGMAWLFFVSWGSYPGLFIFGPEGMHTLSPYANSIGHSICDIIAKEFWTFLAHYLRVLIHEHILIHGDIRKTTKLNIGGTEIEVETLVEDE

SEQ ID NO: 399 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEAYHTVPKGRCRQVVTGMAWLFFVSWGSYPILWAVGPEGLLKLSPYANSIGHSICDIIAKEFWTFLAHHLRIKIHEHILIHGDIRKTTKLNIGGTEIEVETLVEDE

SEQ ID NO: 400 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGYQTWKSTCGWEEIYVATIEMIKFIIEYFHEFDSPATVYLSNGNHAYCLRYFEWLLTCPVILIRLSNLTGLANDYNKRTMGLIVSCVGMIVFGMAAGLSKGYVRVIFFLMGLCYGGYMYFQAAKCYVEAYHTVPKGRCRQVVTGMAWLFFVSWGSYPILWAVGPEGLLKLSPYANSIGHSICDIIAKEFWTFLAHYLRVLIHEHILIHGDIRKTTKLNIGGTEIEVETLVEDE

SEQ ID NO: 401 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLTGLKNDYSKRTMGLIVSCVGMIVFGMAAGLATDWLKWLLYIVSCIYGGYMYFQAAKCYVEAYHTVPKGHCRMVVKLMAYAYFASWGSYPILFILGPEGFGVLSPYANSIGHSICDIIAKEFWTFLAHHLRIKIHEHILIHGDIRKTTKLNIGGTEIEVETLVEDE

SEQ ID NO: 402 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEAYHTVPKGRCRQVVTGMAWLFFVSWGSYPILWAVGPEGLLKLSPYANSIGHSICDIIAKEFWTFLAHHLRIKIHEHIIMYGDIRRPVSSQFLGRKVDVLAFVTEE

SEQ ID NO: 403 - protein, 294 aa, Artificial Sequence
  Synthetic Polypeptide
RMLFQTSYTLENNGSVICIPNNGQCFCLAWLKSNGALWEQETARGFQWFAFSIAIALLTFYGFSAWKATCGWEEVYVCCVEVLFVTLEIFKEFSSPATVYLSTGNHAYCLRYFEWLLTCPVILIHLSNLTGLANDYNKRTMGLLVSCVGMIVFGMAAGLATDWLKWLLYIVSCIYGGYMYFQAAKCYVESYYIMPAGGCKKLVLAMTAVYYSSWGMFPILFILGPEGFGVLSPYANSIGHSICDIIAKEFWTFLAHHLRIKIHEHIIMYGDIRRPVSSQFLGRKVDVLAFVTEE

SEQ ID NO: 404 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSGGNHAYCLRYFEWLLSCPVILIRLSNITGLANDYNKRTMGLIVSCVGMIVFGMAAGLATGWVKWLFYCIGLVYGIYTFFNAAKVYIESYYIMPKGRCRQVVTGMAWLFFVSWGSYPGLFIFGPEGMHTLSPYANSIGHSICDIIAKEFWTFLAHYLRVLIHEHIIMYGDIRRPVSSQFLGRKVDVLAFVTEE

SEQ ID NO: 405 - protein, 293 aa, Artificial Sequence
  Synthetic Polypeptide
GFDELAKGAVVPEDHFVCGPADKCYCSAWLHSRGTNAEKLAANILQWIAFSIAIALLTFYGFSAWKATCGWEEVYVCCVEVLFVTLEIFKEFSEPAVIYSSNGNKTVWLRYAEWLLTCPVILIHLSNITGLSEAYNKRTMALLVSCVGMIVFGMAAGLATDWLKWLLYIVSCIYGGYMYFQAAKCYVEAYHTVPKGRCRQVVTGMAWLFFVSWGMFPILFILGPEGFGVLSVAGSTIGHTIADLLSKNIWGLLGHFLRIKIHEHIIMYGDIRRPVSSQFLGRKVDVLAFVTEE

SEQ ID NO: 406 - protein, 293 aa, Artificial Sequence
  Synthetic Polypeptide
GFDELAKGAVVPEDHFVCGPADKCYCSAWLHSRGTPGEKIGAQVCQWIAVFLSALFLAFYGWHAYKASVGWEEVYVCSVELIKVILEIYFEFTSPATVYLSTGNHAYCLRYFEWLLTCPVILIHLSNLTGLANDYNKRTMGLLVSCVGMIVFGMAAGLATDWLKWLLYIVSCIYGGYMYFQAAKCYVEAYHTVPKGRCRQVVTGMAWLFFVSWGMFPILFILGPEGFGVLSPYANSIGHSICDIIAKEFWTFLAHHLRIKIHEHIIMYGDIRRPVSSQFLGRKVDVLAFVTEE

SEQ ID NO: 407 - protein, 293 aa, Artificial Sequence
  Synthetic Polypeptide
GFDELAKGAVVPEDHFVCGPADKCYCSAWLHSRGALWEQETARGFQWFTFALSALCLMFYGYQTWKSTCGWEEIYVATIEMIKFIIEYFHEFDSPATVYLSTGNHAYCLRYFEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWGSYPILWAVGPEGLLKLSVAGSTIGHTIADLLSKNIWGLLGHFLRIKIHEHIIMYGDIRRPVSSQFLGRKVDVLAFVTEE

SEQ ID NO: 408 - protein, 294 aa, Artificial Sequence
  Synthetic Polypeptide
RMLFQTSYTLENNGSVICIPNNGQCFCLAWLKSNGALWEQETARGFQWFTFALSALCLMFYGYQTWKSTCGWEEIYVATIEMIKFIIEYFHEFDSPATVYLSTGNHAYCLRYFEWLLTCPVILIHLSNITGLSEAYNKRTMALLVSCVGMIVFGMAAGLATDWLKWLLYIVSCIYGGYMYFQAAKCYVEAYHTVPKGRCRQVVTGMAWLFFVSWLMFPGLFIFGPEGMHTLSVAGSTIGHTIADLLSKNIWGLLGHFLRIKIHEHILIHGDIRKTTKMEIGGEEVEVEEFVEEE

SEQ ID NO: 409 - protein, 293 aa, Artificial Sequence
  Synthetic Polypeptide
GFDELAKGAVVPEDHFVCGPADKCYCSAWLHSRGALWEQETARGFQWFTFALSALCLMFYGYQTWKSTCGWEEIYVATIEMIKFIIEYFHEFDEPAVIYSSNGNKTVWLRYAEWLLSCPVILIRLSNLSGLKNDYSKRTMGLIVSCVGMIVFGMAAGLATDWLKWLLYIVSCIYGGYMYFQAAKCYVEAYHTVPKGRCRQVVTGMAWLFFVSWGSYPILWAVGPEGLLKLSPYANSIGHSICDIIAKEFWTFLAHHLRIKIHEHIIMYGDIRRPVSSQFLGRKVDVLAFVTEE

SEQ ID NO: 410 - protein, 293 aa, Artificial Sequence
  Synthetic Polypeptide
GFDELAKGAVVPEDHFVCGPADKCYCSAWLHSRGTPGEKIGAQVCQWIAVSIAIALLTFYGWHAYKASVGWEEVYVCSVELIKVILEIYFEFTSPATVYLSNGNHAYCLRYFEWLLTCPVILIRLSNITGLANDYNKRTMGLIVSCVGMIVFGMAAGLSKGYVRVIFFLMGLCYGGYMYFQAAKCYVESYYIMPKGHCRMVVKLMAYAYFASWGSYPILWAVGPEGLLKLSPYANSIGHSICDIIAKEFWTFLAHHLRIKIHEHIIMYGDIRRPVSSQFLGRKVDVLAFVTEE

SEQ ID NO: 411 - protein, 293 aa, Artificial Sequence
  Synthetic Polypeptide
GFDELAKGAVVPEDHFVCGPADKCYCSAWLHSRGALWEQETARGFQWFAFFLSALFLAFYGYQTWKSTCGWEEIYVATIEMIKFIIEYFHEFDSPATVYLSTGNHAYCLRYFEWLLTCPVILIHLSNITGLSEAYNKRTMALIVSCVGMIVFGMAAGLATDWLKWLLYIVSCIYGTQTFYNAGIIYVESYYIMPKGRCRQVVTGMAWLFFVSWGMFPILFILGPEGFGVLSVAGSTIGHTIADLLSKNIWGLLGHYLRVLIHEHIIMYGDIRRPVSSQFLGRKVDVLAFVTEE

SEQ ID NO: 412 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGYQTWKSTCGWEEIYVATIEMIKFIIEYFHEFDSPATVYLSNGNHAYCLRYFEWLLTCPVILIRLSNLTGLSEAYNKRTMGLIVSCVGMIVFGMAAGLSKGYVRVIFFLMGLCYGGYMYFQAAKCYVEAYHTVPAGGCKKLVLAMTAVYYSSWLSYPGLFIFGPEGMHTLSPYANSIGHSICDIIAKEFWTFLAHFLRIKIHEHILIHGDIRKTTKLNIGGTEIEVETLVEDE

SEQ ID NO: 413 - protein, 294 aa, Artificial Sequence
  Synthetic Polypeptide
RMLFQTSYTLENNGSVICIPNNGQCFCLAWLKSNGTPGEKIGAQVCQWITFALSALCLMFYGYQTWKSTCGWEEIYVATIEMIKFIIEYFHEFDSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDE

SEQ ID NO: 414 - protein, 293 aa, Artificial Sequence
  Synthetic Polypeptide
GFDELAKGAVVPEDHFVCGPADKCYCSAWLHSRGALWEQETARGFQWFAFSIAIALLTFYGFSAWKATCGWEEVYVCCVEVLFVTLEIFKEFSSPAMLFLYGGNITPWLRYAEWLLTCPVILIHLSNLTGLANDYNKRTMGLLVSCVGMIVFGMAAGLATDWLKWLLYIVSCIYGGYMYFQAAKCYVEAYHTVPKGRCRQVVTGMAWLFFVSWGSYPILWAVGPEGLLKLSVAGSTIGHTIADLLSKNIWGLLGHFLRIKIHEHILIHGDIRKTTKLNIGGTEIEVETLVEDE

SEQ ID NO: 415 - protein, 291 aa, Artificial Sequence
  Synthetic Polypeptide
EYHAPAGYQVNPPYHPVHGYEEQCSSIYIYYGALWEQETARGFQWFAVFLSALFLAFYGWHAYKASVGWEEVYVCSVELIKVILEIYFEFTSPAMLFLYTGNITPCLRYFEWLLTCPVILIHLSNITGLSEAYNKRTMALIVSCVGMIVFGMAAGLATDWLKWLLYIVSCIYGTQTFYNAGIIYVESYYIMPKGHCRMVVKLMAYAYFASWGMFPILFILGPEGFGVLSVAGSTIGHTIADLLSKNIWGLLGHHLRIKIHEHIIMYGDIRRPVSSQFLGRKVDVLAFVTEE

SEQ ID NO: 416 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSGGNHAYCLRYFEWLLSCPVILIRLSNLSGLSEAYNKRTMGLIVSCVGMIVFGMAAGLATGWVKWLFYCIGLVYGIYTFFNAAKVYIEANHSVPKGRCRQVVTGMAWLFFVSWGSYPILFILGPEGFGVLSPYANSIGHSICDIIAKEFWTFLAHYLRVLIHEHILIHGDIRKTTKMEIGGEEVEVEEFVEEE

SEQ ID NO: 417 - protein, 293 aa, Artificial Sequence
  Synthetic Polypeptide
GFDELAKGAVVPEDHFVCGPADKCYCSAWLHSRGTNAEKLAANILQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVESYYIMPAGGCKKLVLAMTAVYYSSWLMFPGLFIFGPEGMHTLSPYANSIGHSICDIIAKEFWTFLAHHLRIKIHEHILIHGDIRKTTKMEIGGEEVEVEEFVEEE

SEQ ID NO: 418 - protein, 293 aa, Artificial Sequence
  Synthetic Polypeptide
GFDELAKGAVVPEDHFVCGPADKCYCSAWLHSRGALWEQETARGFQWFAFSIAIALLTFYGFSAWKATCGWEEVYVCCVEVLFVTLEIFKEFSSPAMLFLYGGNITPWLRYAEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGMFPILFILGPEGFGVLSPYANSIGHSICDIIAKEFWTFLAHHLRIKIHEHILIHGDIRKTTKLNIGGTEIEVETLVEDE

SEQ ID NO: 419 - protein, 291 aa, Artificial Sequence
  Synthetic Polypeptide
EYHAPAGYQVNPPYHPVHGYEEQCSSIYIYYGTPGEKIGAQVCQWIAVFLSALFLAFYGWHAYKASVGWEEVYVCSVELIKVILEIYFEFTEPAVIYSSNGNKTVWLRYAEWLLSCPVILIRLSNLSGLKNDYSKRTMGLIVSDLGTICMGVTAALATGWVKWLFYCIGLVYGTQTFYNAGIIYVESYYIMPAGGCKKLVLAMTAVYYSSWGMFPILFILGPEGFGVLSVAGSTIGHTIADLLSKNIWGLLGHFLRIKIHEHIIMYGDIRRPVSSQFLGRKVDVLAFVTEE

SEQ ID NO: 420 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGYQTWKSTCGWEEIYVATIEMIKFIIEYFHEFDSPATVYLSGGNHAYCLRYFEWLLTCPVILIRLSNLTGLANDYNKRTMGLIVSCVGMIVFGMAAGLATGWVKWLFYCIGLVYGGYMYFQAAKCYVEAYHTVPKGHCRMVVKLMAYAYFASWGSYPILFILGPEGFGVLSPYANSIGHSICDIIAKEFWTFLAHHLRIKIHEHILIHGDIRKTTKLNIGGTEIEVETLVEDE

SEQ ID NO: 421 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVESYYIMPAGGCKKLVLAMTAVYYSSWGMFPILFILGPEGFGVLSPYANSIGHSICDIIAKEFWTFLAHHLRIKIHEHIIMYGDIRRPVSSQFLGRKVDVLAFVTEE

SEQ ID NO: 422 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGYQTWKSTCGWEEIYVATIEMIKFIIEYFHEFDSPATVYLSTGNHAYCLRYFEWLLTCPVILIRLSNITGLANDYNKRTMGLIVSCVGMIVFGMAAGLATDWLKWLLYIVSCIYGGYMYFQAAKCYVESYYIMPKGHCRMVVKLMAYAYFASWGSYPILFILGPEGFGVLSPYANSIGHSICDIIAKEFWTFLAHHLRIKIHEHIIMYGDIRRPVSSQFLGRKVDVLAFVTEE

SEQ ID NO: 423 - protein, 294 aa, Artificial Sequence
  Synthetic Polypeptide
RMLFQTSYTLENNGSVICIPNNGQCFCLAWLKSNGTNAEKLAANILQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKMEIGGEEVEVEEFVEEE

SEQ ID NO: 424 - protein, 294 aa, Artificial Sequence
  Synthetic Polypeptide
RMLFQTSYTLENNGSVICIPNNGQCFCLAWLKSNGTPGEKIGAQVCQWIAVFLSALFLAFYGWHAYKASVGWEEVYVCSVELIKVILEIYFEFTSPATVYLSTGNHAYCLRYFEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHIIMYGDIRRPVSSQFLGRKVDVLAFVTEE

SEQ ID NO: 425 - protein, 293 aa, Artificial Sequence
  Synthetic Polypeptide
GFDELAKGAVVPEDHFVCGPADKCYCSAWLHSRGALWEQETARGFQWFAFFLSALFLAFYGYQTWKSTCGWEEIYVATIEMIKFIIEYFHEFDSPATVYLSGGNHAYCLRYFEWLLTCPVILIHLSNITGLKNDYSKRTMGLIVSCVGMIVFGMAAGLATGWVKWLFYCIGLVYGGYMYFQAAKCYVESYYIMPKGRCRQVVTGMAWLFFVSWGMFPILFILGPEGFGVLSVAGSTIGHTIADLLSKNIWGLLGHYLRVLIHEHIIMYGDIRRPVSSQFLGRKVDVLAFVTEE

SEQ ID NO: 426 - protein, 293 aa, Artificial Sequence
  Synthetic Polypeptide
GFDELAKGAVVPEDHFVCGPADKCYCSAWLHSRGALWEQETARGFQWFAFFLSALFLAFYGYQTWKSTCGWEEIYVATIEMIKFIIEYFHEFDSPATVYLSGGNHAYCLRYFEWLLTCPVILIHLSNLTGLSEAYNKRTMGLIVSCVGMIVFGMAAGLATGWVKWLFYCIGLVYGIYTFFNAAKVYIEAYHTVPKGRCRQVVTGMAWLFFVSWGMFPILFILGPEGFGVLSVAGSTIGHTIADLLSKNIWGLLGHYLRVLIHEHILIHGDIRKTTKLNIGGTEIEVETLVEDE

SEQ ID NO: 427 - protein, 293 aa, Artificial Sequence
  Synthetic Polypeptide
GFDELAKGAVVPEDHFVCGPADKCYCSAWLHSRGALWEQETARGFQWFAVFLSALFLAFYGWHAYKASVGWEEVYVCSVELIKVILEIYFEFTSPATVYLSNGNHAYCLRYFEWLLTCPVILIHLSNITGLSEAYNKRTMGLIVSCVGMIVFGMAAGLSKGYVRVIFFLMGLCYGGYMYFQAAKCYVESYYIMPKGRCRQVVTGMAWLFFVSWGMFPILFILGPEGFGVLSVAGSTIGHTIADLLSKNIWGLLGHYLRVLIHEHIIMYGDIRRPVSSQFLGRKVDVLAFVTEE

SEQ ID NO: 428 - protein, 293 aa, Artificial Sequence
  Synthetic Polypeptide
GFDELAKGAVVPEDHFVCGPADKCYCSAWLHSRGALWEQETARGFQWFAVFLSALFLAFYGWHAYKASVGWEEVYVCSVELIKVILEIYFEFTSPATVYLSTGNHAYCLRYFEWLLTCPVILIHLSNITGLKNDYSKRTMGLIVSCVGMIVFGMAAGLATDWLKWLLYIVSCIYGIYTFFNAAKVYIESYYIMPAGGCKKLVLAMTAVYYSSWLMFPILFILGPEGFGVLSVAGSTIGHTIADLLSKNIWGLLGHFLRIKIHEHIIMYGDIRRPVSSQFLGRKVDVLAFVTEE

SEQ ID NO: 429 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSGGNHAYCLRYFEWLLSCPVILIRLSNLTGLSEAYNKRTMALIVSCVGMIVFGMAAGLATGWVKWLFYCIGLVYGTQTFYNAGIIYVEAYHTVPKGRCRQVVTGMAWLFFVSWGSYPILWAVGPEGLLKLSPYANSIGHSICDIIAKEFWTFLAHYLRVLIHEHILIHGDIRKTTKLNIGGTEIEVETLVEDE

SEQ ID NO: 430 - protein, 293 aa, Artificial Sequence
  Synthetic Polypeptide
GFDELAKGAVVPEDHFVCGPADKCYCSAWLHSRGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHIIMYGDIRRPVSSQFLGRKVDVLAFVTEE

SEQ ID NO: 431 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGYQTWKSTCGWEEIYVATIEMIKFIIEYFHEFDSPATVYLSTGNHAYCLRYFEWLLTCPVILIRLSNLTGLSEAYNKRTMALIVSCVGMIVFGMAAGLATDWLKWLLYIVSCIYGTQTFYNAGIIYVEAYHTVPKGRCRQVVTGMAWLFFVSWGSYPILFILGPEGFGVLSPYANSIGHSICDIIAKEFWTFLAHYLRVLIHEHILIHGDIRKTTKLNIGGTEIEVETLVEDE

SEQ ID NO: 432 - protein, 294 aa, Artificial Sequence
  Synthetic Polypeptide
RMLFQTSYTLENNGSVICIPNNGQCFCLAWLKSNGALWEQETARGFQWFAVFLSALFLAFYGWHAYKASVGWEEVYVCSVELIKVILEIYFEFTEPAVIYSSGGNKTVWLRYAEWLLTCPVILIHLSNITGLSEAYNKRTMGLLVSDLGTICMGVTAALATGWVKWLFYCIGLVYGGYMYFQAAKCYVESYYIMPKGRCRQVVTGMAWLFFVSWGMFPILFILGPEGFGVLSVAGSTIGHTIADLLSKNIWGLLGHYLRVLIHEHIIMYGDIRRPVSSQFLGRKVDVLAFVTEE

SEQ ID NO: 433 - protein, 293 aa, Artificial Sequence
  Synthetic Polypeptide
GFDELAKGAVVPEDHFVCGPADKCYCSAWLHSRGALWEQETARGFQWFAVFLSALFLAFYGWHAYKASVGWEEVYVCSVELIKVILEIYFEFTSPATVYLSGGNHAYCLRYFEWLLTCPVILIHLSNITGLKNDYSKRTMGLIVSCVGMIVFGMAAGLATGWVKWLFYCIGLVYGIYTFFNAAKVYIESYYIMPKGRCRQVVTGMAWLFFVSWGMFPILWAVGPEGLLKLSVAGSTIGHTIADLLSKNIWGLLGHYLRVLIHEHIIMYGDIRRPVSSQFLGRKVDVLAFVTEE

SEQ ID NO: 434 - protein, 293 aa, Artificial Sequence
  Synthetic Polypeptide
GFDELAKGAVVPEDHFVCGPADKCYCSAWLHSRGALWEQETARGFQWFAFFLSALFLAFYGFSAWKATCGWEEVYVCCVEVLFVTLEIFKEFSSPATVYLSGGNHAYCLRYFEWLLSCPVILIHLSNITGLSEAYNKRTMGLIVSCVGMIVFGMAAGLATGWVKWLFYCIGLVYGGYMYFQAAKCYVESYYIMPAGGCKKLVLAMTAVYYSSWLMFPILFILGPEGFGVLSVAGSTIGHTIADLLSKNIWGLLGHFLRIKIHEHIIMYGDIRRPVSSQFLGRKVDVLAFVTEE

SEQ ID NO: 435 - protein, 293 aa, Artificial Sequence
  Synthetic Polypeptide
GFDELAKGAVVPEDHFVCGPADKCYCSAWLHSRGTNAEKLAANILQWITFALSALCLMFYGYQTWKSTCGWEEIYVATIEMIKFIIEYFHEFDSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEAYHTVPKGRCRQVVTGMAWLFFVSWGMFPILFILGPEGFGVLSVAGSTIGHTIADLLSKNIWGLLGHFLRIKIHEHIIMYGDIRRPVSSQFLGRKVDVLAFVTEE

SEQ ID NO: 436 - protein, 293 aa, Artificial Sequence
  Synthetic Polypeptide
GFDELAKGAVVPEDHFVCGPADKCYCSAWLHSRGALWEQETARGFQWFTFALSALCLMFYGYQTWKSTCGWEEIYVATIEMIKFIIEYFHEFDSPATVYLSTGNHAYCLRYFEWLLTCPVILIHLSNITGLSEAYNKRTMALLVSCVGMIVFGMAAGLATDWLKWLLYIVSCIYGGYMYFQAAKCYVEAYHTVPKGRCRQVVTGMAWLFFVSWGMFPILFILGPEGFGVLSVAGSTIGHTIADLLSKNIWGLLGHFLRIKIHEHIIMYGDIRRPVSSQFLGRKVDVLAFVTEE

SEQ ID NO: 437 - protein, 293 aa, Artificial Sequence
  Synthetic Polypeptide
GFDELAKGAVVPEDHFVCGPADKCYCSAWLHSRGTPGEKIGAQVCQWIAVSIAIALLTFYGWHAYKASVGWEEVYVCSVELIKVILEIYFEFTSPATVYLSGGNHAYCLRYFEWLLTCPVILIRLSNLTGLKNDYSKRTMGLIVSCVGMIVFGMAAGLATGWVKWLFYCIGLVYGIYTFFNAAKVYIEAYHTVPKGRCRQVVTGMAWLFFVSWGSYPILFILGPEGFGVLSPYANSIGHSICDIIAKEFWTFLAHYLRVLIHEHILIHGDIRKTTKLNIGGTEIEVETLVEDE

SEQ ID NO: 438 - protein, 294 aa, Artificial Sequence
  Synthetic Polypeptide
RMLFQTSYTLENNGSVICIPNNGQCFCLAWLKSNGALWEQETARGFQWFTFALSALCLMFYGYQTWKSTCGWEEIYVATIEMIKFIIEYFHEFDSPATVYLSTGNHAYCLRYFEWLLTCPVILIHLSNLTGLANDYNKRTMGLLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHIIMYGDIRRPVSSQFLGRKVDVLAFVTEE

SEQ ID NO: 439 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSGGNHAYCLRYFEWLLSCPVILIRLSNITGLSEAYNKRTMGLIVSCVGMIVFGMAAGLATGWVKWLFYCIGLVYGIYTFFNAAKVYIESYYIMPKGHCRMVVKLMAYAYFASWGSYPILFILGPEGFGVLSPYANSIGHSICDIIAKEFWTFLAHHLRIKIHEHIIMYGDIRRPVSSQFLGRKVDVLAFVTEE

SEQ ID NO: 440 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDSPATVYLSTGNHAYCLRYFEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDE

SEQ ID NO: 441 - protein, 294 aa, Artificial Sequence
  Synthetic Polypeptide
RMLFQTSYTLENNGSVICIPNNGQCFCLAWLKSNGTPGEKIGAQVCQWITFALSALCLMFYGYQTWKSTCGWEEIYVATIEMIKFIIEYFHEFDEPAVIYSSNGNKTVWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHIIMYGDIRRPVSSQFLGRKVDVLAFVTEE

SEQ ID NO: 442 - protein, 293 aa, Artificial Sequence
  Synthetic Polypeptide
GFDELAKGAVVPEDHFVCGPADKCYCSAWLHSRGALWEQETARGFQWFAVFLSALFLAFYGWHAYKASVGWEEVYVCSVELIKVILEIYFEFTSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEAYHTVPKGRCRQVVTGMAWLFFVSWGMFPILFILGPEGFGVLSPYANSIGHSICDIIAKEFWTFLAHHLRIKIHEHIIMYGDIRRPVSSQFLGRKVDVLAFVTEE

SEQ ID NO: 443 - protein, 293 aa, Artificial Sequence
  Synthetic Polypeptide
GFDELAKGAVVPEDHFVCGPADKCYCSAWLHSRGALWEQETARGFQWFAFFLSALFLAFYGFSAWKATCGWEEVYVCCVEVLFVTLEIFKEFSSPATVYLSTGNHAYCLRYFEWLLSCPVILIHLSNITGLANDYNKRTMALIVSCVGMIVFGMAAGLATDWLKWLLYIVSCIYGTQTFYNAGIIYVESYYIMPKGRCRQVVTGMAWLFFVSWGMFPILFILGPEGFGVLSVAGSTIGHTIADLLSKNIWGLLGHYLRVLIHEHIIMYGDIRRPVSSQFLGRKVDVLAFVTEE

SEQ ID NO: 444 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGYQTWKSTCGWEEIYVATIEMIKFIIEYFHEFDSPATVYLSGGNHAYCLRYFEWLLTCPVILIRLSNITGLKNDYSKRTMALIVSCVGMIVFGMAAGLATGWVKWLFYCIGLVYGTQTFYNAGIIYVESYYIMPKGRCRQVVTGMAWLFFVSWGSYPILFILGPEGFGVLSPYANSIGHSICDIIAKEFWTFLAHYLRVLIHEHIIMYGDIRRPVSSQFLGRKVDVLAFVTEE

SEQ ID NO: 445 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLTGLANDYNKRTMGLIVSCVGMIVFGMAAGLATDWLKWLLYIVSCIYGIYTFFNAAKVYIEAYHTVPAGGCKKLVLAMTAVYYSSWLSYPILFILGPEGFGVLSPYANSIGHSICDIIAKEFWTFLAHFLRIKIHEHILIHGDIRKTTKLNIGGTEIEVETLVEDE

SEQ ID NO: 446 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSNGNKTVWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDE

SEQ ID NO: 447 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSGGNKTVWLRYAEWLLTCPVILIHLSNLTGLANDYNKRTMGLLVSDLGTICMGVTAALATGWVKWLFYCIGLVYGGYMYFQAAKCYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 448 - protein, 294 aa, Artificial Sequence
  Synthetic Polypeptide
RMLFQTSYTLENNGSVICIPNNGQCFCLAWLKSNGTPGEKIGAQVCQWITFALSALCLMFYGYQTWKSTCGWEEIYVATIEMIKFIIEYFHEFDEPAVIYSSNGNKTVWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDE

SEQ ID NO: 449 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSGGNKTVWLRYAEWLLTCPVILIHLSNLTGLANDYNKRTMALLVSDIGTIVWGTTAALATGWVKWLFYCIGLVYGTQTFYNAGIIYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 450 - protein, 294 aa, Artificial Sequence
  Synthetic Polypeptide
RMLFQTSYTLENNGSVICIPNNGQCFCLAWLKSNGALWEQETARGFQWFAFFLSALFLAFYGYQTWKSTCGWEEIYVATIEMIKFIIEYFHEFDEPAVIYSSGGNKTVWLRYAEWLLTCPVILIHLSNLTGLANDYNKRTMALLVSDIGTIVWGTTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHYLRVLIHEHILIHGDIRKTTKLNIGGTEIEVETLVEDE

SEQ ID NO: 451 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSGGNKTVWLRYAEWLLTCPVILIHLSNLTGLANDYNKRTMGLLVSDIGTIVWGTTAALATGWVKWLFYCIGLVYGGYMYFQAAKCYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 452 - protein, 294 aa, Artificial Sequence
  Synthetic Polypeptide
RMLFQTSYTLENNGSVICIPNNGQCFCLAWLKSNGALWEQETARGFQWFAVFLSALFLAFYGWHAYKASVGWEEVYVCSVELIKVILEIYFEFTEPAVIYSSGGNKTVWLRYAEWLLTCPVILIHLSNITGLKNDYSKRTMGLLVSDLGTICMGVTAALATGWVKWLFYCIGLVYGGYMYFQAAKCYVESYYIMPKGRCRQVVTGMAWLFFVSWGMFPILFILGPEGFGVLSVAGSTIGHTIADLLSKNIWGLLGHYLRVLIHEHIIMYGDIRRPVSSQFLGRKVDVLAFVTEE

SEQ ID NO: 453 - protein, 293 aa, Artificial Sequence
  Synthetic Polypeptide
GFDELAKGAVVPEDHFVCGPADKCYCSAWLHSRGALWEQETARGFQWFAVFLSALFLAFYGWHAYKASVGWEEVYVCSVELIKVILEIYFEFTSPATVYLSGGNHAYWLRYAEWLLTCPVILIHLSNITGLANDYNKRTMALLVSDLGTICMGVTAALATGWVKWLFYCIGLVYGTQTFYNAGIIYVESYYIMPAGGCKKLVLAMTAVYYSSWLMFPILFILGPEGFGVLSVAGSTIGHTIADLLSKNIWGLLGHFLRIKIHEHIIMYGDIRRPVSSQFLGRKVDVLAFVTEE

SEQ ID NO: 454 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDEPAVIYSSGGNKTVWLRYAEWLLTCPVILIHLSNLTGLKNDYSKRTMALLVSDIGTIVWGTTAALATGWVKWLFYCIGLVYGTQTFYNAGIIYVEAYHTVPKGRCRQVVTGMAWLFFVSWGMFPILFILGPEGFGVLSVYGSTVGHTIIDLMSKNCWGLLGHYLRVLIHEHILIHGDIRKTTKLNIGGTEIEVETLVEDE

SEQ ID NO: 455 - protein, 294 aa, Artificial Sequence
  Synthetic Polypeptide
RMLFQTSYTLENNGSVICIPNNGQCFCLAWLKSNGTNAEKLAANILQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEAYHTVPKGRCRQVVTGMAWLFFVSWGSYPILWAVGPEGLLKLSPYANSIGHSICDIIAKEFWTFLAHHLRIKIHEHILIHGDIRKTTKMEIGGEEVEVEEFVEEE

SEQ ID NO: 456 - protein, 293 aa, Artificial Sequence
  Synthetic Polypeptide
GFDELAKGAVVPEDHFVCGPADKCYCSAWLHSRGALWEQETARGFQWFAVFLSALFLAFYGWHAYKASVGWEEVYVCSVELIKVILEIYFEFTSPATVYLSGGNHAYWLRYAEWLLTCPVILIHLSNITGLSEAYNKRTMALLVSDLGTICMGVTAALATGWVKWLFYCIGLVYGTQTFYNAGIIYVESYYIMPKGRCRQVVTGMAWLFFVSWGMFPILFILGPEGFGVLSVAGSTIGHTIADLLSKNIWGLLGHYLRVLIHEHIIMYGDIRRPVSSQFLGRKVDVLAFVTEE

SEQ ID NO: 457 - protein, 294 aa, Artificial Sequence
  Synthetic Polypeptide
RMLFQTSYTLENNGSVICIPNNGQCFCLAWLKSNGTNAEKLAANILQWITFALSALCLMFYGYQTWKSTCGWEEIYVATIEMIKFIIEYFHEFDSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDE

SEQ ID NO: 458 - protein, 294 aa, Artificial Sequence
  Synthetic Polypeptide
RMLFQTSYTLENNGSVICIPNNGQCFCLAWLKSNGALWEQETARGFQWFAFFLSALFLAFYGYQTWKSTCGWEEIYVATIEMIKFIIEYFHEFDEPAVIYSSGGNKTVWLRYAEWLLTCPVILIHLSNLTGLANDYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHYLRVLIHEHILIHGDIRKTTKLNIGGTEIEVETLVEDE

SEQ ID NO: 459 - protein, 293 aa, Artificial Sequence
  Synthetic Polypeptide
GFDELAKGAVVPEDHFVCGPADKCYCSAWLHSRGALWEQETARGFQWFAVFLSALFLAFYGWHAYKASVGWEEVYVCSVELIKVILEIYFEFTSPATVYLSGGNHAYWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWLMFPILFILGPEGFGVLSVAGSTIGHTIADLLSKNIWGLLGHFLRIKIHEHIIMYGDIRRPVSSQFLGRKVDVLAFVTEE

SEQ ID NO: 460 - protein, 294 aa, Artificial Sequence
  Synthetic Polypeptide
RMLFQTSYTLENNGSVICIPNNGQCFCLAWLKSNGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWGMFPILFILGPEGFGVLSVAGSTIGHTIADLLSKNIWGLLGHFLRIKIHEHIIMYGDIRRPVSSQFLGRKVDVLAFVTEE

SEQ ID NO: 461 - protein, 294 aa, Artificial Sequence
  Synthetic Polypeptide
RMLFQTSYTLENNGSVICIPNNGQCFCLAWLKSNGTPGEKIGAQVCQWITFALSALCLMFYGYQTWKSTCGWEEIYVATIEMIKFIIEYFHEFDSPAMLFLYGGNITPWLRYAEWLLTCPVILIHLSNITGLSEAYNKRTMALLVSCVGMIVFGMAAGLATDWLKWLLYIVSCIYGGYMYFQAAKCYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDE

SEQ ID NO: 462 - protein, 294 aa, Artificial Sequence
  Synthetic Polypeptide
RMLFQTSYTLENNGSVICIPNNGQCFCLAWLKSNGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEAYHTVPKGRCRQVVTGMAWLFFVSWGSYPILWAVGPEGLLKLSPYANSIGHSICDIIAKEFWTFLAHHLRIKIHEHILIHGDIRKTTKMEIGGEEVEVEEFVEEE

SEQ ID NO: 463 - protein, 293 aa, Artificial Sequence
  Synthetic Polypeptide
GFDELAKGAVVPEDHFVCGPADKCYCSAWLHSRGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWGMFPILFILGPEGFGVLSVAGSTIGHTIADLLSKNIWGLLGHFLRIKIHEHIIMYGDIRRPVSSQFLGRKVDVLAFVTEE

SEQ ID NO: 464 - protein, 293 aa, Artificial Sequence
  Synthetic Polypeptide
GFDELAKGAVVPEDHFVCGPADKCYCSAWLHSRGALWEQETARGFQWFAVFLSALFLAFYGWHAYKASVGWEEVYVCSVELIKVILEIYFEFTSPATVYLSTGNHAYCLRYFEWLLTCPVILIHLSNITGLSEAYNKRTMALLVSDLGTICMGVTAALATGWVKWLFYCIGLVYGTQTFYNAGIIYVESYYIMPAGGCKKLVLAMTAVYYSSWGMFPILFILGPEGFGVLSVAGSTIGHTIADLLSKNIWGLLGHFLRIKIHEHIIMYGDIRRPVSSQFLGRKVDVLAFVTEE

SEQ ID NO: 465 - protein, 293 aa, Artificial Sequence
  Synthetic Polypeptide
GFDELAKGAVVPEDHFVCGPADKCYCSAWLHSRGALWEQETARGFQWFAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEAYHTVPKGRCRQVVTGMAWLFFVSWGSYPILWAVGPEGLLKLSPYANSIGHSICDIIAKEFWTFLAHHLRIKIHEHILIHGDIRKTTKMEIGGEEVEVEEFVEEE

SEQ ID NO: 466 - protein, 293 aa, Artificial Sequence
  Synthetic Polypeptide
GFDELAKGAVVPEDHFVCGPADKCYCSAWLHSRGALWEQETARGFQWFAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHIIMYGDIRRPVSSQFLGRKVDVLAFVTEE

SEQ ID NO: 467 - protein, 294 aa, Artificial Sequence
  Synthetic Polypeptide
RMLFQTSYTLENNGSVICIPNNGQCFCLAWLKSNGALWEQETARGFQWFAVFLSALFLAFYGWHAYKASVGWEEVYVCSVELIKVILEIYFEFTEPAVIYSSGGNKTVWLRYAEWLLTCPVILIHLSNITGLANDYNKRTMGLLVSDLGTICMGVTAALATGWVKWLFYCIGLVYGGYMYFQAAKCYVESYYIMPKGRCRQVVTGMAWLFFVSWGMFPILFILGPEGFGVLSVAGSTIGHTIADLLSKNIWGLLGHYLRVLIHEHIIMYGDIRRPVSSQFLGRKVDVLAFVTEE

SEQ ID NO: 468 - protein, 293 aa, Artificial Sequence
  Synthetic Polypeptide
GFDELAKGAVVPEDHFVCGPADKCYCSAWLHSRGTNAEKLAANILQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEAYHTVPKGRCRQVVTGMAWLFFVSWGSYPILWAVGPEGLLKLSPYANSIGHSICDIIAKEFWTFLAHHLRIKIHEHILIHGDIRKTTKMEIGGEEVEVEEFVEEE

SEQ ID NO: 469 - protein, 294 aa, Artificial Sequence
  Synthetic Polypeptide
RMLFQTSYTLENNGSVICIPNNGQCFCLAWLKSNGTPGEKIGAQVCQWITFALSALCLMFYGYQTWKSTCGWEEIYVATIEMIKFIIEYFHEFDSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSPYANSIGHSICDIIAKEFWTFLAHHLRIKIHEHILIHGDIRKTTKLNIGGTEIEVETLVEDE

SEQ ID NO: 470 - protein, 294 aa, Artificial Sequence
  Synthetic Polypeptide
RMLFQTSYTLENNGSVICIPNNGQCFCLAWLKSNGALWEQETARGFQWFAVFLSALFLAFYGWHAYKASVGWEEVYVCSVELIKVILEIYFEFTSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHIIMYGDIRRPVSSQFLGRKVDVLAFVTEE

SEQ ID NO: 471 - protein, 294 aa, Artificial Sequence
  Synthetic Polypeptide
RMLFQTSYTLENNGSVICIPNNGQCFCLAWLKSNGALWEQETARGFQWFTFALSALCLMFYGYQTWKSTCGWEEIYVATIEMIKFIIEYFHEFDSPAMLFLYGGNITPWLRYAEWLLTCPVILIHLSNITGLSEAYNKRTMALLVSDLGTICMGVTAALATGWVKWLFYCIGLVYGTQTFYNAGIIYVEAYHTVPKGRCRQVVTGMAWLFFVSWGMFPILFILGPEGFGVLSVAGSTIGHTIADLLSKNIWGLLGHFLRIKIHEHILIHGDIRKTTKLNIGGTEIEVETLVEDE

SEQ ID NO: 472 - protein, 293 aa, Artificial Sequence
  Synthetic Polypeptide
GFDELAKGAVVPEDHFVCGPADKCYCSAWLHSRGTNAEKLAANILQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHIIMYGDIRRPVSSQFLGRKVDVLAFVTEE

SEQ ID NO: 473 - protein, 293 aa, Artificial Sequence
  Synthetic Polypeptide
GFDELAKGAVVPEDHFVCGPADKCYCSAWLHSRGTNAEKLAANILQWIAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKLNIGGTEIEVETLVEDE

SEQ ID NO: 474 - protein, 293 aa, Artificial Sequence
  Synthetic Polypeptide
GFDELAKGAVVPEDHFVCGPADKCYCSAWLHSRGTPGEKIGAQVCQWIAFSIAIALLTFYGFSAWKATCGWEEVYVCCVEVLFVTLEIFKEFSSPATVYLSTGNHAYCLRYFEWLLSCPVILIRLSNLTGLANDYNKRTMGLIVSCVGMIVFGMAAGLATDWLKWLLYIVSCIYGGYMYFQAAKCYVEAYHTVPKGHCRMVVKLMAYAYFASWGSYPILFILGPEGFGVLSPYANSIGHSICDIIAKEFWTFLAHHLRIKIHEHILIHGDIRKTTKLNIGGTEIEVETLVEDE

SEQ ID NO: 475 - protein, 293 aa, Artificial Sequence
  Synthetic Polypeptide
GFDELAKGAVVPEDHFVCGPADKCYCSAWLHSRGALWEQETARGFQWFAFSIAIALLTFYGFSAWKATCGWEEVYVCCVEVLFVTLEIFKEFSSPATVYLSTGNHAYCLRYFEWLLSCPVILIRLSNLSGLKNDYSKRTMGLIVSCVGMIVFGMAAGLATDWLKWLLYIVSCIYGGYMYFQAAKCYVEANHSVPKGHCRMVVKLMAYAYFASWGSYPILWAVGPEGLLKLSPYANSIGHSICDIIAKEFWTFLAHHLRIKIHEHILIHGDIRKTTKLNIGGTEIEVETLVEDE

What is claimed is:

1. A recombinant or synthetic protein of comprising an amino acid sequence having at least 95% sequence identity to an amino acid sequence selected from the group consisting of SEQ ID NOs: 93, 109, 125-130, 132, 133, 136-138, 142, 146, 149, 150, 157-175 and 178-196.

2. A nucleic acid molecule comprising a nucleotide sequence encoding the recombinant or synthetic protein of claim 1.

3. An isolated cell, comprising:
(a) a recombinant or synthetic protein of claim 1;
(b) a nucleic acid molecule of claim 2; or both.

4. A composition, comprising
(a) a recombinant or synthetic protein of claim 1;
(b) a nucleic acid molecule of claim 2;
(c) an isolated cell of claim 3; or any combination thereof.

5. A method of delivering a protein or a nucleotide sequence encoding the protein to a subject, the method comprising:
   i) administering the protein, or the nucleotide sequence encoding the protein, to the subject, and
   ii) expressing the protein in the subject,
   wherein the protein comprises an amino acid sequence having at least 95% sequence identity to SEQ ID NOs: 5-19, 21-42, 44, 46-49, 51-56, 58, 60-71, 73-74, 76-139, 141-147, 149-154, 157-175, and 178-196, and wherein the subject is a mammal.

6. The method of claim 5, wherein a recombinant expression vector comprising the nucleotide sequence encoding the protein is administered to ocular cells of the subject at $1 \times 10^{10}$ genome copies (GC) or more per kg of the subject.

7. The method of claim 5, wherein the nucleotide sequence encoding the protein is introduced to the subject by administering to the subject a recombinant expression vector comprising a nucleotide sequence encoding the protein.

8. The method of claim 7, wherein the administering is via intraocular injection, intravitreal injection, subretinal injection, intravenous delivery, or any combination thereof.

9. The method of claim 5, wherein the protein, or a nucleotide sequence encoding the protein, is administered to the eye of the subject, and is expressed in one or more electrically active cells in the eye.

10. The method of claim 5, comprising delivering light to the subject, and wherein the delivering light comprises placing a plurality of fiber optic-cables on the skull of the subject.

11. The method of claim 9, wherein the protein is expressed in one or more retinal cells in the eye of the subject.

* * * * *